(12) United States Patent
Bloom

(10) Patent No.: US 12,516,095 B2
(45) Date of Patent: Jan. 6, 2026

(54) PEPTIDE HORMONE ANALOGUES

(71) Applicant: IP2IPO INNOVATIONS LIMITED, London (GB)

(72) Inventor: Stephen Robert Bloom, London (GB)

(73) Assignee: IP2IPO INNOVATIONS LIMITED, London (GB)

( * ) Notice: Subject to any disclaimer, the term of this patent is extended or adjusted under 35 U.S.C. 154(b) by 902 days.

(21) Appl. No.: 17/618,375

(22) PCT Filed: Jun. 12, 2020

(86) PCT No.: PCT/GB2020/051425
§ 371 (c)(1),
(2) Date: Dec. 10, 2021

(87) PCT Pub. No.: WO2020/249966
PCT Pub. Date: Dec. 17, 2020

(65) Prior Publication Data
US 2022/0315636 A1    Oct. 6, 2022

(30) Foreign Application Priority Data

Jun. 12, 2019 (GB) .................... 1908424

(51) Int. Cl.
*A61K 38/00* (2006.01)
*A61P 3/04* (2006.01)
*C07K 14/605* (2006.01)

(52) U.S. Cl.
CPC .............. *C07K 14/605* (2013.01); *A61P 3/04* (2018.01)

(58) Field of Classification Search
CPC ...... A61P 3/04; A61P 1/16; A61P 3/10; A61P 9/00; A61P 25/00; A61P 25/08; A61P 25/16; A61P 25/28; A61K 38/00; C07K 14/605

See application file for complete search history.

(56) References Cited

U.S. PATENT DOCUMENTS

| | | | |
|---|---|---|---|
| 4,179,337 | A | 12/1979 | Davis et al. |
| 5,936,092 | A | 8/1999 | Shen et al. |
| 6,093,692 | A | 7/2000 | Shen et al. |
| 6,225,445 | B1 | 5/2001 | Shen et al. |
| 6,410,707 | B2 | 6/2002 | Wagner et al. |
| 2016/0199438 | A1 | 7/2016 | Bokvist et al. |
| 2024/0336669 | A1* | 10/2024 | Bloom .................... A61P 3/04 |

FOREIGN PATENT DOCUMENTS

| | | |
|---|---|---|
| AU | 2013366690 A1 | 7/2015 |
| AU | 2015225945 A1 | 10/2016 |
| CN | 1444567 A | 9/2003 |
| EP | 3080155 A1 | 10/2016 |
| JP | 2016-526012 A | 9/2016 |
| JP | 2017509698 A | 4/2017 |
| WO | WO 2002/010141 A1 | 2/2002 |
| WO | WO 2013/004983 A1 | 1/2013 |
| WO | WO 2013/092703 A2 | 6/2013 |
| WO | WO 2014/041375 A1 | 3/2014 |
| WO | WO 2014/096145 A1 | 6/2014 |
| WO | WO 2014/096148 A1 | 6/2014 |
| WO | WO 2014/170496 A1 | 10/2014 |
| WO | WO 2015/086731 A1 | 6/2015 |
| WO | WO 2015/132599 A1 | 9/2015 |
| WO | WO 2016/198624 A1 | 12/2016 |
| WO | WO-2017178829 A1 * | 10/2017 |
| WO | WO 2019/110981 A1 | 6/2019 |
| WO | WO-2020249966 A1 | 12/2020 |

OTHER PUBLICATIONS

Bech, E.M., et al., "Chemical Strategies for Half-Life Extension of Biopharmaceuticals: Lipidation and Its Alternatives," *ACS Medicinal Chemistry Letters*, 2018, vol. 9, Issue 7, pp. 577-580.
International Preliminary Report on Patentability Chapter I, Patent Cooperation Treaty Application No. PCT/GB2020/051425, mailing date Dec. 23, 2021, 8 pages.
International Search Report and Written Opinion, Patent Cooperation Treaty Application No. PCT/GB2020/051425, mailing date Aug. 31, 2020, 12 pages.
Kenchaiah, S. et al., "Obesity and the Risk of Heart Failure," *The New England Journal of Medicine*, vol. 347, No. 5, Aug. 1, 2002, pp. 305-313.
Lau, J., et al., "Discovery of the Once-Weekly Glucagon-Like Peptide-1 (GLP-1) Analogue Semaglutide," *Journal of Medicinal Chemistry*, 2015, vol. 58, Issue 18, pp. 7370-7380.
Lim, E.L. et al., "Reversal of type 2 diabetes: normalisation of beta cell function in association with decreased pancreas and liver triacylglycerol," *Diabetologia*, vol. 54, Jun. 9, 2011, pp. 2506-2514.
Lyznicki, J. M. et al., "Obesity: assessment and management in primary care," *American Family Physician*, vol. 63, No. 11, Jun. 2001, pp. 2185-2196.
Massie, B., "Obesity and Heart Failure—Risk Factor or Mechanism?", *The New England Journal of Medicine*, 2002, 347, pp. 358-359.
Teramoto, S. et al., "Exendin-4, a glucagon-like peptide-1 receptor agonist, provides neuroprotection in mice transient focal cerebral ischemia," *Journal of Cerebral Blood Flow & Metabolism*, vol. 31, Apr. 13, 2011, pp. 1696-1705.

(Continued)

*Primary Examiner* — Lianko G Garyu
*Assistant Examiner* — Mercy H Sabila
(74) *Attorney, Agent, or Firm* — COOLEY LLP

(57) ABSTRACT

The invention provides novel compounds which are peptide hormone analogues, and which are useful in treating disorders such as diabetes and obesity. The compounds of the general sequence recited in the specification possess a tailored profile with regards to potency properties at the glucagon and GLP-1 receptors. With regard to in vivo properties, administration of example peptides of the invention have been shown, in animal models, to result in increased weight loss. Preferred compounds achieve this without reducing food intake significantly.

19 Claims, 40 Drawing Sheets

Specification includes a Sequence Listing.

(56) References Cited

OTHER PUBLICATIONS

UK Search Report, UK Intellectual Property Office Patent Application No. GB1908424.3, Dec. 13, 2019, 4 pages.
Yu, M., et al., "Battle of GLP-1 delivery technologies," *Advanced Drug Delivery Reviews*, vol. 130, May 2018, pp. 113-130.
Goldenberg et al., "Benefits of GLP-1 (Glugacon-Like Peptide 1) Receptor Agonists for Stroke Reduction in Type 2 Diabetes: A Call to Action for Neurologists," Stroke, vol. 53, May 2022, pp. 1813-1822.
Lvoff et al., "Glucagon in Heart Failure and in Cardiogenic Shock," Circulation, vol. 45, Mar. 1972, pp. 534-542.
Murtagh et al., "Haemodynamic effects of glucagon," British Heart Journal, 1970, vol. 32, pp. 307-315.
Nestor et al., "Effects of ALT-801, a GLP-1 and glucagon receptor dual agonist, in a translational mouse model of non-alcoholic steatohepatitis," Scientific Reports, vol. 12, 2022, 11 pages.
Nevola et al., "GLP-1 Receptor Agonists in Non-Alcoholic Fatty Liver Disease: Current Evidence and Future Perspectives," Int. J. Mol. Sci., vol. 24, No. 1703, 2023, 25 pages.
Parab et al., "Role of Glucagon-Like Peptide-1 (GLP-1) Receptor Agonists in Cardiovascular Risk Management in Patients with Type 2 Diabetes Mellitus: A Systematic Review," Cureus, vol. 15, No. 9, Sep. 18, 2023, e45487, 11 pages.

\* cited by examiner

Figure 1

| Ex | G ref | SEQ ID | Note | 1 | 2 | 3 | 4 | 5 | 6 | 7 | 8 | 9 | 10 | 11 | 12 | 13 | 14 | 15 | 16 | 17 | 18 | 19 | 20 | 21 | 22 | 23 | 24 | 25 | 26 | 27 | 28 | 29 |
|---|---|---|---|---|---|---|---|---|---|---|---|---|---|---|---|---|---|---|---|---|---|---|---|---|---|---|---|---|---|---|---|---|
| 1 | 4938 | 1 | | His | AiB | His | Gly | Thr | Phe | Thr | Ser | Asp | Tyr | Ser | Arg | Tyr | Leu | Asp | Glu | Arg | Arg | Ala | Gln | Glu | Phe | Ile | Glu | Trp | Leu | Leu | Ala | Ser |
| 2 | 4962 | 2 | | His | AiB | His | Gly | Thr | Phe | Thr | Ser | Asp | Tyr | Ser | Lys | Tyr | Leu | Asp | Glu | Lys | Lys | Ala | His | Glu | Phe | Ile | Glu | Trp | Leu | Leu | Ala | Ser |
| 3 | 4963 | 3 | | His | AiB | His | Gly | Thr | Phe | Thr | Ser | Asp | Tyr | Ser | Lys | Tyr | Leu | Asp | Glu | Lys | Lys | Ala | His | Glu | Phe | Ile | Glu | Trp | Leu | Leu | Ala | Ser |
| 4 | 4964 | 4 | | His | AiB | His | Gly | Thr | Phe | Thr | Ser | Asp | Tyr | Ser | Lys | Tyr | Leu | Asp | Glu | Lys | Lys | Ala | His | Glu | Phe | Ile | Glu | Trp | Leu | Leu | Ala | Ser |
| 5 | 4965 | 5 | | His | AiB | His | Gly | Thr | Phe | Thr | Ser | Asp | Tyr | Ser | Lys | Tyr | Leu | Asp | Glu | Lys | Lys | Ala | His | Glu | Phe | Ile | Glu | Trp | Leu | Leu | Ala | Ser |
| 6 | 4969 | 6 | | His | AiB | His | Gly | Thr | Phe | Thr | Ser | Asp | Tyr | Ser | Arg | Tyr | Leu | Asp | Glu | Arg | Arg | Ala | Gln | Glu | Phe | Ile | Glu | Trp | Leu | Leu | Thr | Gly |
| 7 | 4970 | 7 | | His | AiB | His | Gly | Thr | Phe | Thr | Ser | Asp | Tyr | Ser | Arg | Tyr | Leu | Asp | Glu | Arg | Arg | Ala | Gln | Glu | Phe | Ile | Glu | Trp | Leu | Leu | Thr | Gly |
| 8 | 4980 | 8 | | His | AiB | His | Gly | Thr | Phe | Thr | Ser | Asp | Tyr | Ser | Arg | Tyr | Leu | Asp | Glu | Arg | Arg | Ala | Gln | Glu | Phe | Ile | Glu | Trp | Leu | Leu | Thr | Gly |
| 9 | 4984 | 9 | | His | AiB | His | Gly | Thr | Phe | Thr | Ser | Asp | Tyr | Ser | Arg | Tyr | Leu | Asp | Glu | Arg | Arg | Ala | Gln | Glu | Phe | Ile | Glu | Trp | Leu | Leu | Thr | Gly |
| 10 | 4985 | 10 | | His | AiB | His | Gly | Thr | Phe | Thr | Ser | Asp | Tyr | Ser | Arg | Tyr | Leu | Asp | Glu | Arg | Arg | Ala | Gln | Glu | Phe | Ile | Glu | Trp | Leu | Leu | Thr | Gly |
| 11 | 4986 | 11 | | His | AiB | His | Gly | Thr | Phe | Thr | Ser | Asp | Tyr | Ser | Arg | Tyr | Leu | Asp | Glu | Arg | Arg | Ala | Gln | Glu | Phe | Ile | Glu | Trp | Leu | Leu | Ala | Ser |
| 12 | 4987 | 12 | | His | AiB | His | Gly | Thr | Phe | Thr | Ser | Asp | Tyr | Ser | Arg | Tyr | Leu | Asp | Glu | Arg | Arg | Ala | Gln | Glu | Phe | Ile | Glu | Trp | Leu | Leu | Ala | Ser |
| 13 | 4988 | 13 | | His | AiB | His | Gly | Thr | Phe | Thr | Ser | Asp | Tyr | Ser | Arg | Tyr | Leu | Asp | Glu | Arg | Arg | Ala | Gln | Glu | Phe | Ile | Glu | Trp | Leu | Leu | Ala | Ser |
| 14 | 4989 | 14 | | His | AiB | His | Gly | Thr | Phe | Thr | Ser | Asp | Tyr | Ser | Arg | Tyr | Leu | Asp | Glu | Arg | Arg | Ala | Gln | Glu | Phe | Ile | Glu | Trp | Leu | Leu | Ala | Ser |
| 15 | 4990 | 15 | | His | AiB | His | Gly | Thr | Phe | Thr | Ser | Asp | Tyr | Ser | Arg | Tyr | Leu | Asp | Glu | Arg | Arg | Ala | Gln | Glu | Phe | Ile | Glu | Trp | Leu | Leu | Ala | Ser |
| 16 | 4991 | 16 | | His | AiB | His | Gly | Thr | Phe | Thr | Ser | Asp | Tyr | Ser | Arg | Tyr | Leu | Asp | Ala | Arg | Arg | Ala | Gln | Glu | Phe | Ile | Glu | Trp | Leu | Leu | Ala | Ser |
| 17 | 4992 | 17 | | His | AiB | His | Gly | Thr | Phe | Thr | Ser | Asp | Tyr | Ser | Arg | Tyr | Leu | Asp | Ala | Arg | Arg | Ala | Gln | Glu | Phe | Ile | Glu | Trp | Leu | Leu | Ala | Ser |
| 18 | 5011 | 18 | | His | AiB | His | Gly | Thr | Phe | Thr | Ser | Asp | Tyr | Ser | Arg | Tyr | Leu | Asp | Ala | Leu | Arg | Ala | Gln | Glu | Phe | Ile | Glu | Trp | Leu | Leu | Ala | Ser |
| 19 | 5018 | 19 | | His | AiB | His | Gly | Thr | Phe | Thr | Ser | Asp | Tyr | Ser | Arg | Tyr | Leu | Asp | Glu | Lys | Arg | Ala | Gln | Glu | Phe | Ile | Glu | Trp | Leu | Leu | Ala | Ser |
| 20 | 5019 | 20 | | His | AiB | His | Gly | Thr | Phe | Thr | Ser | Asp | Tyr | Ser | Lys | Tyr | Leu | Asp | Glu | Lys | Arg | Ala | Gln | Glu | Phe | Ile | Glu | Trp | Leu | Leu | Ala | Ser |
| 21 | 5020 | 21 | | His | AiB | His | Gly | Thr | Phe | Thr | Ser | Asp | Tyr | Ser | Lys | Tyr | Leu | Asp | Glu | Arg | Arg | Ala | Gln | Glu | Phe | Ile | Glu | Trp | Leu | Leu | Ala | Ser |
| 22 | 5021 | 22 | | His | AiB | His | Gly | Thr | Phe | Thr | Ser | Asp | Tyr | Ser | Arg | Tyr | Leu | Asp | Gln | Lys | Arg | Ala | Gln | Glu | Phe | Ile | Glu | Trp | Leu | Leu | Ala | Ser |
| 23 | 5023 | 23 | | His | AiB | His | Gly | Thr | Phe | Thr | Ser | Asp | Tyr | Ser | Arg | Tyr | Leu | Asp | Gln | Arg | Arg | Ala | Gln | Glu | Phe | Ile | Glu | Trp | Leu | Leu | Ala | Ser |
| 24 | 5024 | 24 | | His | AiB | His | Gly | Thr | Phe | Thr | Ser | Asp | Tyr | Ser | Arg | Tyr | Leu | Asp | Gln | Arg | Arg | Ala | Gln | Glu | Phe | Ile | Glu | Trp | Leu | Leu | Ala | Ser |
| 25 | 5025 | 25 | | His | AiB | His | Gly | Thr | Phe | Thr | Ser | Asp | Tyr | Ser | Arg | Tyr | Leu | Asp | Glu | Lys | Arg | Ala | Gln | Glu | Phe | Ile | Glu | Trp | Leu | Leu | Gln | Gly |
| 26 | 5030 | 26 | | His | AiB | His | Gly | Thr | Phe | Thr | Ser | Asp | Tyr | Ser | Arg | Tyr | Leu | Asp | Glu | Lys | Arg | Ala | Gln | Glu | Phe | Ile | Glu | Trp | Leu | Leu | Gln | Ser |
| 27 | 5031 | 27 | | His | AiB | His | Gly | Thr | Phe | Thr | Ser | Asp | Tyr | Ser | Arg | Tyr | Leu | Asp | Glu | Arg | Arg | Ala | Gln | Glu | Phe | Ile | Glu | Trp | Leu | Leu | Gln | Ser |
| 28 | 5032 | 28 | | His | AiB | His | Gly | Thr | Phe | Thr | Ser | Asp | Tyr | Ser | Arg | Tyr | Leu | Asp | Glu | Arg | Arg | Ala | Gln | Glu | Phe | Ile | Glu | Trp | Leu | Leu | Gln | Gly |
| 29 | 5046 | 29 | | His | AiB | His | Gly | Thr | Phe | Thr | Ser | Asp | Tyr | Ser | Arg | Tyr | Leu | Asp | Glu | Arg | Arg | Ala | Gln | Glu | Phe | Ile | Glu | Trp | Leu | Leu | Ala | Ser |
| 30 | 5047 | 30 | | His | AiB | His | Gly | Thr | Phe | Thr | Ser | Asp | Tyr | Ser | Arg | Tyr | Leu | Asp | Glu | Arg | Arg | Ala | Gln | Glu | Phe | Ile | Glu | Trp | Leu | Leu | Thr | Gly |
| 31 | 5051 | 31 | | His | AiB | His | Gly | Thr | Phe | Thr | Ser | Asp | Tyr | Ser | Arg | Tyr | Leu | Asp | Glu | Arg | Arg | Ala | Gln | Glu | Phe | Ile | Glu | Trp | Leu | Leu | Ala | Thr |
| 32 | 5052 | 32 | | His | AiB | His | Gly | Thr | Phe | Thr | Ser | Asp | Tyr | Ser | Arg | Tyr | Leu | Asp | Glu | Lys | Arg | Ala | Gln | Glu | Phe | Ile | Glu | Trp | Leu | Leu | Ala | Thr |
| 33 | 5053 | 33 | | His | AiB | His | Gly | Thr | Phe | Thr | Ser | Asp | Tyr | Ser | Arg | Tyr | Leu | Asp | Glu | Arg | Arg | Ala | Gln | Glu | Phe | Ile | Glu | Trp | Leu | Leu | Ala | Gly |
| 34 | 5058 | 34 | | His | AiB | His | Gly | Thr | Phe | Thr | Ser | Asp | Tyr | Ser | Arg | Tyr | Leu | Asp | Glu | Arg | Arg | Ala | Gln | Glu | Phe | Ile | Glu | Trp | Leu | Leu | Ala | Ser |
| 35 | 5059 | 35 | | His | AiB | His | Gly | Thr | Phe | Thr | Ser | Asp | Tyr | Ser | Arg | Tyr | Leu | Asp | Glu | Arg | Arg | Ala | Gln | Glu | Phe | Ile | Glu | Trp | Leu | Leu | His | Ser |
| 36 | 5067 | 36 | | His | AiB | His | Gly | Thr | Phe | Thr | Ser | Asp | Tyr | Ser | Arg | Tyr | Leu | Asp | Glu | Arg | Arg | Ala | Gln | Glu | Phe | Ile | Glu | Trp | Leu | Leu | Ala | Ser |
| 37 | 5068 | 37 | | His | AiB | His | Gly | Thr | Phe | Thr | Ser | Asp | Tyr | Ser | Arg | Tyr | Leu | Asp | Glu | Arg | Arg | Ala | Gln | Glu | Phe | Ile | Glu | Trp | Leu | Leu | Ala | Ser |
| 38 | 5069 | 38 | | His | AiB | His | Gly | Thr | Phe | Thr | Ser | Asp | Tyr | Ser | Arg | Tyr | Leu | Asp | Glu | Arg | Arg | Ala | Gln | Glu | Phe | Ile | Glu | Trp | Leu | Leu | Ala | Ser |

Figure 1 (Continued)

| 30 | 31 | 32 | 33 | 34 | 35 | 36 | 37 | 38 | 39 | 40 | 41 | 42 | 43 | 44 | 45 | 46 | 47 | 48 | Z | n (R=C$_n$) | Ex | 7.5nM single intake | loss | 15nM single intake | loss | 30nM single intake | loss | rpt dose | Ratio Gluc/GLP-1 |
|---|---|---|---|---|---|---|---|---|---|---|---|---|---|---|---|---|---|---|---|---|---|---|---|---|---|---|---|---|---|
| His | His | His | His | His | Pro | Ser | Pro | Pro | Pro | Ser | Gly | Lys | Ser | Trp |  |  |  |  | iii | 14 | 1 |  |  |  |  | 1 | -10 |  |  |
| His | His | His | His | His | Pro | Ser | Gly |  |  |  |  | Lys |  |  |  |  |  |  | iii | 14 | 2 |  |  |  |  | -2 | -9 |  |  |
| His | His | His | His | His | Pro | Ser | Gly |  |  |  |  | Lys |  |  |  |  |  |  | iii | 16 | 3 |  |  |  |  | -16 | -6 |  |  |
| His | His | His | His | His | Pro | Ser | Gly | Gly |  |  |  | Lys |  |  |  |  |  |  | i | 16 | 4 |  |  |  |  | -12 | -7 |  |  |
| His | His | His | His | His | Pro | Ser | Gly | Ser |  |  |  | Lys |  |  |  |  | Gly | Ser | i | 16 | 5 |  |  |  |  | -9 | -8 |  |  |
| His | His | His | His | His | Ala | Ser | Gly | Ser |  |  |  | Lys |  |  |  |  |  |  | i | 16 | 6 |  |  |  |  | -4 | -7 |  |  |
| His | His | His | His | His | Ala | Ser | Gly | Ser |  |  |  | Lys |  |  |  |  | Gly | Ser | iii | 16 | 7 |  |  |  |  | -2 | -13 |  |  |
| His | His | His | His | His | Ala | Ser | Gly | Ser |  |  |  | Lys |  |  |  |  |  |  | i | 16 | 8 |  |  |  |  | 1 | -6 |  |  |
| His | His | His | His | His | Ala | Ser | Gly | Gly |  |  |  | Lys |  |  |  |  |  |  | i | 16 | 9 |  |  |  |  | 3 | -6 |  |  |
| His | His | His | His | His | Ala | Ser | Gly |  |  |  |  | Lys |  |  |  |  | Gly | Ser | iii | 16 | 10 |  |  |  |  | -5 | -8 |  |  |
| His | His | His | His | His | Pro | Ser | Pro | Pro | Pro | Gly |  | Lys |  |  |  |  |  |  | iii | 16 | 11 |  |  |  |  | -8 | -7 |  |  |
| His | His | His | His | His | Pro | Ser | Pro | Pro | Pro | Gly |  | Lys |  |  |  |  |  |  | i | 16 | 12 |  |  |  |  | -4 | -9 |  |  |
| His | His | His | His | His | Pro | Ser | Pro | Pro | Pro | Gly |  | Lys |  |  |  |  | Gly | Ser | i | 16 | 13 |  |  |  |  | -4 | -12 |  |  |
| His | His | His | His | His | Pro | Ser | Pro | Gly | Pro | Gly |  | Lys |  |  |  |  |  |  | iii | 16 | 14 |  |  |  |  | -11 | 2 |  |  |
| His | His | His | His | His | Pro | Ser | Pro | Gly | Pro |  |  | Lys |  |  |  |  |  |  | i | 16 | 15 |  |  |  |  | 2 | -3 |  |  |
| His | His | His | His | His | Pro | Ser | Pro | Gly | Pro | Gly | Ser | Lys |  |  |  |  |  |  | iii | 16 | 16 |  |  |  |  | -6 | -6 |  |  |
| His | His | His | His | His | Ala | Ser | Pro | Gly | Pro | Gly | Ser | Lys |  |  |  |  |  |  | iii | 16 | 17 |  |  |  |  | 7 | -6 |  |  |
| His | His | His | His | His | Ser | Gly | Glu | Gly | Pro | Gly |  | Lys |  |  |  |  |  |  | i | 18 | 18 |  |  |  |  | 14 | -4 |  |  |
| His | His | His | His | His | Ser | Gly | Glu | Gly | Pro |  |  | Lys |  |  |  |  |  |  | i | 18 | 19 |  |  |  |  | -1 | -8 |  |  |
| His | His | His | His | His | Ser | Gly | Glu | Gly | Pro | Gly | Ser | Lys |  |  |  |  |  |  | iii | 18 | 20 |  |  |  |  | 4 | -14 |  |  |
| His | His | His | His | His | Ala | Ser | Gly | Pro | Pro | Gly |  | Lys |  |  |  |  |  |  | i | 18 | 21 |  |  |  |  | -5 | -11 |  |  |
| His | His | His | His | His | Pro | Ser | Pro |  |  |  |  | Lys |  |  |  |  |  |  | i | 18 | 22 |  |  |  |  | -3 | 0 |  |  |
| His | His | His | His | His | Pro | Ser | Pro |  |  |  |  | Lys |  |  |  |  |  |  | i | 18 | 23 |  |  |  |  | -2 | -7 |  |  |
| His | His | His | His | His | Pro | Ser | Pro | Pro | Pro | Ser |  | Lys |  |  |  |  |  |  | i | 18 | 24 |  |  |  |  | 7 | -7 |  |  |
| His | His | His | His | His | Pro | Ser | Pro | Pro | Pro | Ser |  | Lys | Ser |  |  |  |  |  | i | 18 | 25 |  |  |  |  | -3 | -3 |  |  |
| His | His | His | His | His | Pro | Ser | Pro | Pro | Pro | Ser |  | Lys | Ser | Trp |  |  |  |  | i | 18 | 26 |  |  |  |  | 0 | 1 |  |  |
| His | His | His | His | His | Pro | Ser | Pro | Pro | Pro | Ser | Gly | Lys |  |  |  |  | Gly |  | i | 16 | 27 |  |  |  |  | -2 | 0 |  |  |
| His | His | His | His | His | Pro | Ser | Pro | Pro | Pro | Ser | Gly | Lys | Ser |  |  |  |  |  | i | 18 | 28 |  |  |  |  | 0 | 3 |  |  |
| His | His | His | His | His | Pro | Ser | Pro | Pro | Pro | Ser | Gly | Lys | Ser | Trp |  |  |  |  | i | 18 | 29 |  |  |  |  | 0 | -12 |  |  |
| His | His | His | His | His | Ala | Ser | Pro | Pro | Pro | Ser |  | Lys |  |  |  |  | Gly | Ser | i | 18 | 30 |  |  |  |  | -7 | -11 |  |  |
| His | His | His | His | His | Pro | Ser | Pro | Pro |  |  |  | Lys |  |  |  |  |  |  | i | 16 | 31 |  |  |  |  | -4 | -7 |  |  |
| His | His | His | His | His | Ser | Gly | Glu | Pro |  |  |  | Lys |  |  |  |  |  |  | i | 16 | 32 |  |  |  |  | 3 | -8 |  |  |
| His | His | His | His | His | Ser | Gly | Glu | Gly |  |  |  | Lys |  |  |  |  | Gly | Ser | i | 16 | 33 |  |  |  |  | -2 | -8 |  |  |
| His | His | His | His | His | Pro | Ser | Gly |  |  |  |  | Lys |  |  |  |  | Gly | Ser | i | 16 | 34 |  |  |  |  | 5 | -10 |  |  |
| His | His | His | His | His | Pro | Ser | Pro | Pro | Pro | Ser |  | Lys | Ser | Trp | Gly | Ser | Gly | Ser | i | 16 | 35 |  |  |  |  | 12 | -8 |  |  |
| His | His | His | His | His | Pro | Ser | Pro | Pro | Pro | Ser |  | Lys | Ser | Trp | Gly | Ser |  |  | ii | 16 | 36 |  |  |  |  | -16 | -7 |  |  |
| His | His | His | His | His | Pro | Ser | Pro | Pro | Pro | Ser |  | Lys | Ser | Trp | Gly | Ser |  |  | i | 16 | 37 |  |  |  |  | -2 | -6 |  |  |
| His | His | His | His | His | Pro | Ser | Pro | Pro | Pro | Ser |  | Lys | Ser | Trp | Gly | Ser |  |  | i | 18 | 38 |  |  |  |  | -27 | -6 |  |  |

Figure 1 (Continued)

| Ex | G ref | SEQ ID | Note | 1 | 2 | 3 | 4 | 5 | 6 | 7 | 8 | 9 | 10 | 11 | 12 | 13 | 14 | 15 | 16 | 17 | 18 | 19 | 20 | 21 | 22 | 23 | 24 | 25 | 26 | 27 | 28 | 29 |
|---|---|---|---|---|---|---|---|---|---|---|---|---|---|---|---|---|---|---|---|---|---|---|---|---|---|---|---|---|---|---|---|---|
| 39 | 5070 | 39 | | His | AiB | His | Gly | Thr | Phe | Thr | Ser | Asp | Tyr | Ser | Arg | Tyr | Leu | Asp | Glu | Arg | Arg | Ala | Gln | Glu | Phe | Ile | Glu | Trp | Leu | Leu | Ala | Ser |
| 40 | 5072 | 40 | | His | AiB | His | Gly | Thr | Phe | Thr | Ser | Asp | Tyr | Ser | Arg | Tyr | Leu | Asp | Glu | Arg | Arg | Ala | Gln | Glu | Phe | Ile | Glu | Trp | Leu | Leu | Thr | Gly |
| 41 | 5074 | 41 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Gly |
| 42 | 5084 | 42 | | His | AiB | His | Gly | Thr | Phe | Thr | Ser | Asp | Tyr | Ser | Arg | Tyr | Leu | Asp | Glu | Arg | Arg | Ala | Gln | Glu | Phe | Ile | Glu | Trp | Leu | Leu | Ala | Ser |
| 43 | 5087 | 43 | | His | AiB | His | Gly | Thr | Phe | Thr | Ser | Asp | Tyr | Ser | Arg | Tyr | Leu | Asp | Glu | Arg | Arg | Ala | Gln | Glu | Phe | Ile | Glu | Trp | Leu | Leu | Thr | Gly |
| 44 | 5088 | 44 | | His | AiB | His | Gly | Thr | Phe | Thr | Ser | Asp | Tyr | Ser | Lys | Tyr | Leu | Asp | Glu | Arg | Arg | Ala | Gln | Glu | Phe | Ile | Glu | Trp | Leu | Leu | Gln | Gly |
| 45 | 5089 | 45 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Gly |
| 46 | 5117 | 46 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 47 | 5118 | 47 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 48 | 5119 | 48 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 49 | 5120 | 49 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 50 | 5121 | 50 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 51 | 5122 | 51 | | His | AiB | His | Gly | Thr | Phe | Thr | Ser | Asp | Tyr | Ser | Arg | Tyr | Leu | Asp | Glu | Arg | Arg | Ala | Gln | Glu | Phe | Ile | Glu | Trp | Leu | Leu | Ala | Ser |
| 52 | 5123 | 52 | | His | AiB | His | Gly | Thr | Phe | Thr | Ser | Asp | Tyr | Ser | Arg | Tyr | Leu | Asp | Ala | Arg | Arg | Ala | Gln | Glu | Phe | Ile | Glu | Trp | Leu | Leu | Ala | Ser |
| 53 | 5126 | 53 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 54 | 5127 | 54 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 55 | 5128 | 55 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 56 | 5129 | 56 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 57 | 5130 | 57 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 58 | 5131 | 58 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 59 | 5132 | 59 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 60 | 5133 | 60 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 61 | 5134 | 61 | | His | AiB | His | Gly | Thr | Phe | Thr | Ser | Asp | Tyr | Ser | Arg | Tyr | Leu | Asp | Glu | Arg | Arg | Ala | Gln | Glu | Phe | Ile | Glu | Trp | Leu | Leu | Ala | Ser |
| 62 | 5135 | 62 | | His | AiB | His | Gly | Thr | Phe | Thr | Ser | Asp | Tyr | Ser | Arg | Tyr | Leu | Asp | Ala | Arg | Arg | Ala | Gln | Glu | Phe | Ile | Glu | Trp | Leu | Leu | Ala | Ser |
| 63 | 5136 | 63 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 64 | 5137 | 64 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 65 | 5138 | 65 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 66 | 5139 | 66 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 67 | 5140 | 67 | | His | AiB | His | Gly | Thr | Phe | Thr | Ser | Asp | Tyr | Ser | Lys | Tyr | Leu | Asp | Ala | Arg | Arg | Ala | Gln | Glu | Phe | Ile | Glu | Trp | Leu | Leu | Ala | Ser |
| 68 | 5143 | 68 | | His | AiB | His | Gly | Thr | Phe | Thr | Ser | Asp | Tyr | Ser | Arg | Tyr | Leu | Asp | Glu | Arg | Arg | Ala | Gln | Glu | Phe | Ile | Glu | Trp | Leu | Leu | Ala | Ser |
| 69 | 5144 | 69 | | His | AiB | His | Gly | Thr | Phe | Thr | Ser | Asp | Tyr | Ser | Arg | Tyr | Leu | Asp | Glu | Arg | Arg | Ala | Gln | Glu | Phe | Ile | Glu | Trp | Leu | Leu | Thr | Ser |
| 70 | 5150 | 70 | | His | AiB | His | Gly | Thr | Phe | Thr | Ser | Asp | Tyr | Ser | Arg | Tyr | Leu | Asp | Glu | Arg | Arg | Ala | Gln | Glu | Phe | Ile | Glu | Trp | Leu | Leu | Thr | Ser |
| 71 | 5151 | 71 | | His | AiB | His | Gly | Thr | Phe | Thr | Ser | Asp | Tyr | Ser | Arg | Tyr | Leu | Asp | Glu | Arg | Arg | Ala | Gln | Glu | Phe | Ile | Glu | Trp | Leu | Leu | Thr | Ser |
| 72 | 5156 | 72 | | His | AiB | His | Gly | Thr | Phe | Thr | Ser | Asp | Tyr | Ser | Arg | Tyr | Leu | Asp | Glu | Arg | Arg | Ala | Gln | Glu | Phe | Ile | Glu | Trp | Leu | Leu | Ala | Ser |
| 73 | 5157 | 73 | | His | AiB | His | Gly | Thr | Phe | Thr | Ser | Asp | Tyr | Ser | Arg | Tyr | Leu | Asp | Glu | Arg | Arg | Ala | Gln | Glu | Phe | Ile | Glu | Trp | Leu | Leu | Ala | Ser |
| 74 | 5160 | 74 | | His | AiB | His | Gly | Thr | Phe | Thr | Ser | Asp | Tyr | Ser | Arg | Tyr | Leu | Asp | Glu | Arg | Arg | Ala | Gln | Glu | Phe | Ile | Glu | Trp | Leu | Leu | Ala | Ser |
| 75 | 5163 | 75 | | His | AiB | His | Gly | Thr | Phe | Thr | Ser | Asp | Tyr | Ser | Arg | Tyr | Leu | Asp | Glu | Arg | Arg | Ala | Gln | Glu | Phe | Ile | Glu | Trp | Leu | Leu | Thr | Gly |
| 76 | 5164 | 76 | | His | AiB | His | Gly | Thr | Phe | Thr | Ser | Asp | Tyr | Ser | Arg | Tyr | Leu | Asp | Glu | Arg | Arg | Ala | Gln | Glu | Phe | Ile | Glu | Trp | Leu | Leu | Ala | Ser |
| 77 | 5167 | 77 | | His | AiB | His | Gly | Thr | Phe | Thr | Ser | Asp | Tyr | Ser | Arg | Tyr | Leu | Asp | Glu | Arg | Arg | Ala | Gln | Glu | Phe | Ile | Glu | Trp | Leu | Leu | His | Gly |

Figure 1 (Continued)

| 30 | 31 | 32 | 33 | 34 | 35 | 36 | 37 | 38 | 39 | 40 | 41 | 42 | 43 | 44 | 45 | 46 | 47 | 48 | Z | n (R=Cn) | Ex | 7.5nM single intake | loss | 15nM single intake | loss | 30nM single intake | loss | rpt dose | Ratio Gluc/GLP-1 |
|---|---|---|---|---|---|---|---|---|---|---|---|---|---|---|---|---|---|---|---|---|---|---|---|---|---|---|---|---|---|
| His | His | His | His | His | Pro | Ser | Pro | Pro | Pro | Gly | Ser | Lys |  |  | Gly | Ser | Gly | Ser | i | 16 | 39 |  |  |  |  | -5 | -11 |  |  |
| His | His | His | His | His | Ala | Ser | Gly |  |  |  |  | Lys |  |  | Gly | Ser | Gly | Ser | i | 16 | 40 |  |  |  |  | -11 | -10 |  |  |
| His | His | His | His | His | Ala | Ser | Gly | Ser |  |  |  | Lys |  |  | Gly | Ser | Gly | Ser | i | 16 | 41 |  |  |  |  | -8 | -14 |  |  |
| His | His | His | His | His | Pro | Ser | Pro | Pro | Pro | Ser | Gly | Lys | Ser | Trp |  |  | Gly | Thr | iii | 16 | 42 |  |  |  |  | -31 | -7 |  |  |
| His | His | His | His | His | Ala | Ser | Gly | Ser |  |  |  | Lys |  |  |  |  | Gly | Ser | iii | 16 | 43 |  |  |  |  | -19 | -2 |  |  |
| His | His | His | His | His | Ala | Ser | Gly | Ser |  |  |  | Lys |  |  |  |  | Gly | Ser | iii | 16 | 44 |  |  |  |  | -15 | -6 |  |  |
| His | His | His | His | His | Ala | Ser | Gly | Gly |  |  |  | Lys |  |  |  |  | Gly | Thr | i | 16 | 45 |  |  |  |  | -13 | -9 |  |  |
| His | His | His | His | His | Ser | Gly | Glu | Gly |  |  |  | Lys |  |  |  |  | Gly | Ser | i | 16 | 46 |  |  |  |  | -16 | -16 | 3 | 4 |
| His | His | His | His | His | Ser | Gly | Glu | Gly |  |  |  | Lys |  |  |  |  | Gly | Thr | i | 16 | 47 |  |  |  |  | -4 | -11 |  |  |
| His | His | His | His | His | Ser | Gly | Glu | Gly |  |  |  | Lys |  |  |  |  | Gly | Ser | i | 18 | 48 |  |  |  |  | -11 | -13 |  |  |
| His | His | His | His | His | Ser | Gly | Glu | Gly | Pro |  |  | Lys |  |  |  |  | Gly | Thr | i | 18 | 49 |  |  |  |  | -2 | -10 |  |  |
| His | His | His | His | His | Ser | Gly | Glu | Gly | Gly |  |  | Lys |  |  | Gly | Ser | Gly | Ser | i | 18 | 50 | 0 | -9 | 7 | -15 | -5 | -19 | 1 | 2 |
| His | His | His | His | His | Pro | Ser | Pro | Pro | Pro |  |  | Lys |  |  |  |  | Gly | Ser | i | 18 | 51 |  |  | -4 | -18 | -3 | -15 |  | 3 |
| His | His | His | His | His | Pro | Ser | Pro | Pro |  |  |  | Lys |  |  |  |  | Gly | Thr | i | 18 | 52 |  |  |  |  | -14 | -9 |  |  |
| His | His | His | His | His | Ser | Gly | Glu | Gly |  |  |  | Lys |  |  |  |  | Gly | Ser | iii | 18 | 53 |  |  |  |  | -1 | -1 |  |  |
| His | His | His | His | His | Ser | Gly | Glu | Gly |  |  |  | Lys |  |  | Ser |  | Gly | Thr | i | 18 | 54 | -13 | -13 | 1 |  | -3 | -18 | 1 | 1 |
| His | His | His | His | His | Ser | Gly | Glu | Gly |  |  |  | Lys |  |  |  |  |  | Phe | iii | 18 | 55 |  |  |  |  | 1 | 3 |  |  |
| His | His | His | His | His | Ser | Gly | Glu | Gly |  |  |  | Lys |  |  |  |  |  | Leu | iii | 18 | 56 |  |  |  |  | -11 | 0 |  |  |
| His | His | His | His | His | Ser | Gly | Glu | Gly |  |  |  | Lys |  |  |  |  |  | Asp | iii | 18 | 57 |  |  |  |  | -10 | -10 |  |  |
| His | His | His | His | His | Ser | Gly | Glu | Gly |  |  |  | Lys |  |  |  |  |  | Pro | iii | 18 | 58 |  |  |  |  | 4 | -1 |  |  |
| His | His | His | His | His | Ser | Gly | Glu | Gly |  |  |  | Lys |  |  |  |  |  | His | i | 18 | 59 |  |  |  |  | -10 | -1 |  |  |
| His | His | His | His | His | Ser | Gly | Glu | Gly |  |  |  | Lys |  |  |  | Ser | Gly | Ser | iii | 18 | 60 |  |  |  |  | 4 | -6 |  |  |
| His | His | His | His | His | Ser | Gly | Glu | Gly |  |  |  | Lys |  |  |  | Gly | Ser | Thr | iii | 18 | 61 |  |  |  |  | -2 | -7 |  |  |
| His | His | His | His | His | Ser | Gly | Glu | Gly |  |  |  | Lys |  |  |  | Ser | Ala | Ser | i | 18 | 62 |  |  |  |  | 3 | -8 |  |  |
| His | His | His | His | His | Ala | Ser | Gly |  |  |  |  | Lys |  |  |  |  |  | Arg | iii | 18 | 63 |  |  |  |  | 12 | 3 |  |  |
| His | His | His | His | His | Ala | Ser | Gly |  |  |  |  | Lys |  |  |  |  |  | Lys | iii | 18 | 64 |  |  |  |  | -1 | 0 |  |  |
| His | His | His | His | His | Ala | Ser | Gly |  |  |  |  | Lys |  |  |  |  |  | Trp | iii | 18 | 65 |  |  |  |  | 3 | 0 |  |  |
| His | His | His | His | His | Pro | Ser | Pro | Pro | Pro | Ser | Gly | Lys |  |  |  | Ser | Gly | Gly | i | 18 | 66 |  |  |  |  | -3 | -12 |  |  |
| His | His | His | His | His | Pro | Ser | Pro | Pro | Pro | Ser | Gly | Lys |  |  |  | Thr | Thr | Gly | i | 18 | 67 |  |  |  |  | -17 | -7 |  |  |
| His | His | His | His | His | Pro | Ser | Pro | Pro | Pro | Ser | Gly | Lys |  |  |  | Gly | Ser | Gly | i | 18 | 68 |  |  |  |  | 0 | -5 |  |  |
| His | His | His | His | His | Ser | Gly | Pro |  |  |  |  | Lys |  |  |  |  | Gly | Ser | i | 18 | 69 |  |  |  |  | -1 | -5 |  |  |
| His | His | His | His | His | Ser | Ser | Gly |  |  |  |  | Lys |  |  |  |  | Gly | Thr | i | 18 | 70 |  |  |  |  | -1 | -18 |  |  |
| His | His | His | His | His | Ala | Ser | Gly | Ser |  |  |  | Lys |  |  |  |  |  |  | iii | 18 | 71 |  |  |  |  | 4 | -14 |  |  |
| His | His | His | His | His | Ala | Ser | Gly | Ser |  |  |  | Lys | Ser | Trp |  |  |  |  | i | 18 | 72 |  |  |  |  | 0 | -9 |  |  |
| His | His | His | His | His | Ala | Ser | Gly | Ser |  |  |  | Lys | Glu | Tyr |  |  |  |  | i | 18 | 73 |  |  |  |  | 4 | -5 |  |  |
| His | His | His | His | His | Pro | Ser | Gly | Ser |  |  |  | Lys |  |  |  |  |  |  | i | 18 | 74 |  |  |  |  | 0 | -19 |  | 3 |
| His | His | His | His | His | Ala | Ser | Gly | Ser |  |  |  | Lys |  |  |  |  |  |  | iii | 18 | 75 |  |  |  |  | 3 | -13 |  |  |
| His | His | His | His | His | Ala | Ser | Gly | Ser |  |  |  | Lys |  |  |  |  |  |  | iii | 18 | 76 |  |  | -3 | -15 | 4 | -13 | 1 |  |
| His | His | His | His | His | Pro | Ser | Gly | Ser |  |  |  | Lys |  |  |  |  |  |  | i | 18 | 77 |  |  |  |  | 14 | -9 |  |  |

Figure 1 (Continued)

| Ex | G ref | SEQ ID | Note | 1 | 2 | 3 | 4 | 5 | 6 | 7 | 8 | 9 | 10 | 11 | 12 | 13 | 14 | 15 | 16 | 17 | 18 | 19 | 20 | 21 | 22 | 23 | 24 | 25 | 26 | 27 | 28 | 29 |
|---|---|---|---|---|---|---|---|---|---|---|---|---|---|---|---|---|---|---|---|---|---|---|---|---|---|---|---|---|---|---|---|---|
| 78 | 5168 | 78 | | His | AiB | His | Gly | Thr | Phe | Thr | Ser | Asp | Tyr | Ser | Arg | Tyr | Leu | Asp | Glu | Arg | Arg | Ala | Gln | Glu | Phe | Ile | Glu | Trp | Leu | Leu | His | Gly |
| 79 | 5171 | 79 | | His | AiB | His | Gly | Thr | Phe | Thr | Ser | Asp | Tyr | Ser | Arg | Tyr | Leu | Asp | Glu | Arg | Arg | Ala | Gln | Glu | Phe | Ile | Glu | Trp | Leu | Leu | Ala | Ser |
| 80 | 5172 | 80 | | His | AiB | His | Gly | Thr | Phe | Thr | Ser | Asp | Tyr | Ser | Arg | Tyr | Leu | Asp | Glu | Arg | Arg | Ala | Gln | Glu | Phe | Ile | Glu | Trp | Leu | Leu | Ala | Ser |
| 81 | 5179 | 81 | | His | AiB | His | Gly | Thr | Phe | Thr | Ser | Asp | Tyr | Ser | Arg | Tyr | Leu | Asp | Glu | Arg | Arg | Ala | Gln | Glu | Phe | Ile | Glu | Trp | Leu | Leu | Ala | Thr |
| 82 | 5180 | 82 | | His | AiB | His | Gly | Thr | Phe | Thr | Ser | Asp | Tyr | Ser | Arg | Tyr | Leu | Asp | Gln | Arg | Arg | Ala | Gln | Glu | Phe | Ile | Glu | Trp | Leu | Leu | Ala | Thr |
| 83 | 5181 | 83 | | His | AiB | His | Gly | Thr | Phe | Thr | Ser | Asp | Tyr | Ser | Arg | Tyr | Leu | Asp | Gln | Arg | Arg | Ala | Gln | Glu | Phe | Ile | Glu | Trp | Leu | Leu | Ala | Thr |
| 84 | 5182 | 84 | | His | AiB | His | Gly | Thr | Phe | Thr | Ser | Asp | Tyr | Ser | Arg | Tyr | Leu | Asp | Gln | Arg | Arg | Ala | Gln | Glu | Phe | Ile | Glu | Trp | Leu | Leu | Ala | Thr |
| 85 | 5183 | 85 | | His | AiB | His | Gly | Thr | Phe | Thr | Ser | Asp | Tyr | Ser | Arg | Tyr | Leu | Asp | Glu | Arg | Arg | Ala | Gln | Glu | Phe | Ile | Glu | Trp | Leu | Leu | His | Gly |
| 86 | 5184 | 86 | | His | AiB | His | Gly | Thr | Phe | Thr | Ser | Asp | Tyr | Ser | Arg | Tyr | Leu | Asp | Glu | Lys | Arg | Ala | His | Glu | Phe | Ile | Glu | Trp | Leu | Leu | His | Gly |
| 87 | 5185 | 87 | | His | AiB | His | Gly | Thr | Phe | Thr | Ser | Asp | Tyr | Ser | Arg | Tyr | Leu | Asp | Glu | Lys | Arg | Ala | His | Glu | Phe | Ile | Glu | Trp | Leu | Leu | Thr | Gly |
| 88 | 5186 | 88 | | His | AiB | His | Gly | Thr | Phe | Thr | Ser | Asp | Tyr | Ser | Arg | Tyr | Leu | Asp | Glu | Arg | Arg | Ala | Gln | Glu | Phe | Ile | Glu | Trp | Leu | Leu | Ala | Ser |
| 89 | 5190 | 89 | | His | AiB | His | Gly | Thr | Phe | Thr | Ser | Asp | Tyr | Ser | Arg | Tyr | Leu | Asp | Glu | Arg | Arg | Ala | Gln | Glu | Phe | Ile | Glu | Trp | Leu | Leu | Ala | Ser |
| 90 | 5191 | 90 | | His | AiB | His | Gly | Thr | Phe | Thr | Ser | Asp | Tyr | Ser | Arg | Tyr | Leu | Asp | Glu | Arg | Arg | Ala | Gln | Glu | Phe | Ile | Glu | Trp | Leu | Leu | Ala | Ser |
| 91 | 5198 | 91 | | His | AiB | His | Gly | Thr | Phe | Thr | Ser | Asp | Tyr | Ser | Arg | Tyr | Leu | Asp | Glu | Arg | Arg | Ala | Gln | Glu | Phe | Ile | Glu | Trp | Leu | Leu | Ala | Ser |
| 92 | 5201 | 92 | | His | AiB | His | Gly | Thr | Phe | Thr | Ser | Asp | Tyr | Ser | Arg | Tyr | Leu | Asp | Glu | Arg | Arg | Ala | Gln | Glu | Phe | Ile | Glu | Trp | Leu | Leu | Ala | Ser |
| 93 | 5202 | 93 | | His | AiB | His | Gly | Thr | Phe | Thr | Ser | Asp | Tyr | Ser | Arg | Tyr | Leu | Asp | Glu | Arg | Arg | Ala | Gln | Glu | Phe | Ile | Glu | Trp | Leu | Leu | Ala | Ser |
| 94 | 5203 | 94 | | His | AiB | His | Gly | Thr | Phe | Thr | Ser | Asp | Tyr | Ser | Arg | Tyr | Leu | Asp | Glu | Arg | Arg | Ala | Gln | Glu | Phe | Ile | Glu | Trp | Leu | Leu | Ala | Ser |
| 95 | 5204 | 95 | | His | AiB | His | Gly | Thr | Phe | Thr | Ser | Asp | Tyr | Ser | Arg | Tyr | Leu | Asp | Glu | Arg | Arg | Ala | Gln | Glu | Phe | Ile | Glu | Trp | Leu | Leu | Ala | Ser |
| 96 | 5208 | 96 | | His | AiB | His | Gly | Thr | Phe | Thr | Ser | Asp | Tyr | Ser | Arg | Tyr | Leu | Asp | Glu | Arg | Arg | Ala | Gln | Glu | Phe | Ile | Glu | Trp | Leu | Leu | His | Ser |
| 97 | 5209 | 97 | | His | AiB | His | Gly | Thr | Phe | Thr | Ser | Asp | Tyr | Ser | Arg | Tyr | Leu | Asp | Glu | Arg | Arg | Ala | Gln | Glu | Phe | Ile | Glu | Trp | Leu | Leu | Ala | Ser |
| 98 | 5210 | 98 | | His | AiB | His | Gly | Thr | Phe | Thr | Ser | Asp | Tyr | Ser | Arg | Tyr | Leu | Asp | Ala | Arg | Arg | Ala | Gln | Glu | Phe | Ile | Glu | Trp | Leu | Leu | His | Ser |
| 99 | 5211 | 99 | | His | AiB | His | Gly | Thr | Phe | Thr | Ser | Asp | Tyr | Ser | Arg | Tyr | Leu | Asp | Ala | Lys | Arg | Ala | Gln | Glu | Phe | Ile | Glu | Trp | Leu | Leu | His | Ser |
| 100 | 5212 | 100 | | His | AiB | His | Gly | Thr | Phe | Thr | Ser | Asp | Tyr | Ser | Arg | Tyr | Leu | Asp | Ala | Lys | Arg | Ala | Gln | Glu | Phe | Ile | Glu | Trp | Leu | Leu | His | Ser |
| 101 | 5213 | 101 | | His | AiB | His | Gly | Thr | Phe | Thr | Ser | Asp | Tyr | Ser | Arg | Tyr | Leu | Asp | Ala | Lys | Arg | Ala | Gln | Glu | Phe | Ile | Glu | Trp | Leu | Leu | Ala | Ser |
| 102 | 5214 | 102 | | His | AiB | His | Gly | Thr | Phe | Thr | Ser | Asp | Tyr | Ser | Arg | Tyr | Leu | Asp | Glu | Arg | Arg | Ala | Gln | Glu | Phe | Ile | Glu | Trp | Leu | Leu | Ala | Ser |
| 103 | 5215 | 103 | | His | AiB | His | Gly | Thr | Phe | Thr | Ser | Asp | Tyr | Ser | Lys | Tyr | Leu | Asp | Glu | Arg | Arg | Ala | Gln | Glu | Phe | Ile | Glu | Trp | Leu | Leu | Ala | Ser |
| 104 | 5216 | 104 | | His | AiB | His | Gly | Thr | Phe | Thr | Ser | Asp | Tyr | Ser | Arg | Tyr | Leu | Asp | Glu | Arg | Arg | Ala | Gln | Glu | Phe | Ile | Glu | Trp | Leu | Leu | His | Ser |
| 105 | 5218 | 105 | | His | AiB | His | Gly | Thr | Phe | Thr | Ser | Asp | Tyr | Ser | Arg | Tyr | Leu | Asp | Glu | Arg | Arg | Ala | Gln | Glu | Phe | Ile | Glu | Trp | Leu | Leu | His | Ser |
| 106 | 5219 | 106 | | His | AiB | His | Gly | Thr | Phe | Thr | Ser | Asp | Tyr | Ser | Arg | Tyr | Leu | Asp | Glu | Arg | Arg | Ala | Gln | Glu | Phe | Ile | Glu | Trp | Leu | Leu | Ala | Ser |
| 107 | 5220 | 107 | | His | AiB | His | Gly | Thr | Phe | Thr | Ser | Asp | Tyr | Ser | Arg | Tyr | Leu | Asp | Ala | Lys | Arg | Ala | Gln | Glu | Phe | Ile | Glu | Trp | Leu | Leu | Ala | Ser |
| 108 | 5222 | 108 | | His | AiB | His | Gly | Thr | Phe | Thr | Ser | Asp | Tyr | Ser | Arg | Tyr | Leu | Asp | Glu | Arg | Arg | Ala | Gln | Glu | Phe | Ile | Glu | Trp | Leu | Gln | Ser |
| 109 | 5227 | 109 | | His | AiB | His | Gly | Thr | Phe | Thr | Ser | Asp | Tyr | Ser | Arg | Tyr | Leu | Asp | Glu | Arg | Arg | Ala | Gln | Glu | Phe | Ile | Glu | Trp | Leu | Leu | Gln | Ser |
| 110 | 5228 | 110 | | His | AiB | His | Gly | Thr | Phe | Thr | Ser | Asp | Tyr | Ser | Arg | Tyr | Leu | Asp | Glu | Arg | Arg | Ala | Gln | Glu | Phe | Ile | Glu | Trp | Leu | Leu | Ala | Ser |
| 111 | 5229 | 111 | | His | AiB | His | Gly | Thr | Phe | Thr | Ser | Asp | Tyr | Ser | Arg | Tyr | Leu | Asp | Glu | Arg | Arg | Ala | Gln | Glu | Phe | Ile | Glu | Trp | Leu | Leu | Ala | Ser |
| 112 | 5231 | 112 | | His | AiB | His | Gly | Thr | Phe | Thr | Ser | Asp | Tyr | Ser | Arg | Tyr | Leu | Asp | Ala | Lys | Arg | Ala | Gln | Glu | Phe | Ile | Glu | Trp | Leu | Leu | Ala | Ser |
| 113 | 5235 | 113 | | His | AiB | His | Gly | Thr | Phe | Thr | Ser | Asp | Tyr | Ser | Arg | Tyr | Leu | Asp | Glu | Arg | Arg | Ala | Gln | Glu | Phe | Ile | Glu | Trp | Leu | Leu | Thr | Ser |
| 114 | 5236 | 114 | | His | AiB | His | Gly | Thr | Phe | Thr | Ser | Asp | Tyr | Ser | Arg | Tyr | Leu | Asp | Glu | Arg | Arg | Ala | Gln | Glu | Phe | Ile | Glu | Trp | Leu | Leu | Gln | Ser |
| 115 | 5237 | 115 | | His | AiB | His | Gly | Thr | Phe | Thr | Ser | Asp | Tyr | Ser | Arg | Tyr | Leu | Asp | Glu | Arg | Arg | Ala | Gln | Glu | Phe | Ile | Glu | Trp | Leu | Leu | Thr | Gly |

Figure 1 (Continued)

| 30 | 31 | 32 | 33 | 34 | 35 | 36 | 37 | 38 | 39 | 40 | 41 | 42 | 43 | 44 | 45 | 46 | 47 | 48 | Z | n (R=Cn) | Ex | 7.5nM single intake | loss | 15nM single intake | loss | 30nM single intake | loss | rpt dose intake | loss | Ratio Gluc/GLP-1 |
|---|---|---|---|---|---|---|---|---|---|---|---|---|---|---|---|---|---|---|---|---|---|---|---|---|---|---|---|---|---|---|
| His | His | His | His | His | Pro | Ser | Gly | | | | | | | | | | | | iii | 16 | 78 | | | | | 3 | -8 | | | |
| His | His | His | His | His | Pro | Ser | Pro | Pro | | | | Lys | | | | | | | i | 18 | 79 | | | | | 8 | -13 | | | |
| His | His | His | His | His | Pro | Ser | Pro | Pro | Gly | | | Lys | | | | | Tyr | Thr | i | 18 | 80 | | | | | -7 | -20 | | | 2 |
| His | His | His | His | His | Ser | Gly | Glu | Gly | | | | Lys | | | | | Thr | His | i | 18 | 81 | | | | | -18 | -14 | | | |
| His | His | His | His | His | Ser | Gly | Glu | Gly | | | | Lys | | | | | Gly | Thr | iii | 16 | 82 | | | | | 6 | -3 | | | |
| His | His | His | His | His | Ser | Gly | Glu | Gly | | | | Lys | | | | | Gly | Ser | i | 16 | 83 | | | | | 0 | -7 | | | |
| His | His | His | His | His | Ser | Gly | Glu | Gly | | | | Lys | | | | | | | iii | 16 | 84 | | | | | 3 | -8 | | | |
| His | His | His | His | His | Ala | Ser | Gly | | | | | Lys | | | | | | | i | 18 | 85 | | | | | 4 | -7 | | | |
| His | His | His | His | His | Ala | Ser | Gly | | | | | Lys | | | | | | | iii | 16 | 86 | | | | | -4 | -10 | | | |
| His | His | His | His | His | Ala | Ser | Gly | | | | | Lys | | | | | | | i | 16 | 87 | | | | | -8 | -12 | | | |
| His | His | His | His | His | Pro | Ser | Pro | | | | | Lys | | | Thr | Gly | Ser | Gly | i | 16 | 88 | | | | | 0 | -17 | | | 2 |
| His | His | His | His | His | Pro | Ser | Pro | Pro | Ser | Gly | | Lys | Ser | | | | | | iii | 16 | 89 | | | | | 6 | -11 | | | |
| His | His | His | His | His | Pro | Ser | Pro | Pro | Ser | Gly | | Lys | Ser | Trp | | Gly | Ser | Gly | i | 16 | 90 | | | | | -14 | -5 | | | |
| His | His | His | His | His | Pro | Ser | Pro | Pro | Ser | Gly | | Lys | Ser | Trp | | | | | i | 16 | 91 | | | | | -2 | -6 | | | |
| His | His | His | His | His | Pro | Ser | Pro | Pro | Pro | Gly | | Lys | | | | | Gly | Ser | i | 16 | 92 | | | | | -9 | -13 | | | |
| His | His | His | His | His | Pro | Ser | Pro | Pro | Pro | Gly | | Lys | | | | | Gly | Thr | i | 14 | 93 | | | | | 9 | -10 | | | |
| His | His | His | His | His | Pro | Ser | Pro | Pro | Pro | Gly | | Lys | | | | | Gly | Thr | iii | 16 | 94 | | | | | -3 | -9 | | | |
| His | His | His | His | His | Pro | Ser | Pro | Pro | Pro | Gly | | Lys | | | | | Gly | Thr | i | 18 | 95 | | | | | -6 | -10 | | | |
| His | His | His | His | His | Pro | Ser | Pro | Pro | Pro | Gly | | Lys | | | | | Gly | Thr | i | 16 | 96 | | | | | -4 | -9 | | | |
| His | His | His | His | His | Pro | Ser | Pro | Pro | | | | Lys | | | | | Gly | Thr | ii | 16 | 97 | | | | | -5 | -7 | | | |
| His | His | His | His | His | Ser | Gly | Glu | Pro | Pro | | | Lys | | | | | Gly | Thr | iii | 16 | 98 | | | | | -5 | -8 | | | |
| His | His | His | His | His | Ser | Gly | Glu | Pro | Pro | | | Lys | | | | | Gly | Ser | ii | 16 | 99 | | | | | -5 | -11 | | | |
| His | His | His | His | His | Pro | Ser | Pro | Pro | Pro | Gly | | Lys | | | | | Gly | Ser | ii | 16 | 100 | | | | | -6 | -9 | | | |
| His | His | His | His | His | Ser | Pro | Gly | Pro | Pro | Gly | | Lys | | | | | Gly | Ser | ii | 16 | 101 | | | | | -2 | -10 | | | |
| His | His | His | His | His | Ser | Pro | Gly | Gly | Pro | Ser | | Lys | Ser | | | | Gly | Thr | iii | 16 | 102 | | | | | -14 | -8 | | | |
| His | His | His | His | His | Ser | Pro | Gly | Gly | Pro | Ser | | Lys | Ser | | | | Gly | Ser | iii | 16 | 103 | | | | | -5 | -6 | | | |
| His | His | His | His | His | Pro | Ser | Pro | Pro | Pro | Ser | | Lys | Ser | | | | Gly | Thr | iii | 16 | 104 | | | | | -11 | -9 | | | |
| His | His | His | His | His | Glu | Ser | Pro | Gly | Pro | Ser | Gly | Lys | Ser | Trp | | | | | ii | 16 | 105 | | | | | 4 | -13 | | | |
| His | His | His | His | His | Pro | Ser | Gly | Gly | Pro | Ser | Gly | Lys | Ser | Trp | | | Gly | Ser | i | 16 | 106 | | | -10 | -16 | 7 | -16 | 6 | 5 | 3 |
| His | His | His | His | His | Pro | Ser | Pro | Pro | Pro | Ser | Gly | Lys | Glu | | | | Gly | Thr | ii | 16 | 107 | -7 | -11 | | | -1 | -19 | 8 | 9 | 2 |
| His | His | His | His | His | Pro | Ser | Pro | Pro | Pro | Ser | Gly | Lys | Glu | Trp | | | Gly | Ser | i | 16 | 108 | | | | | -8 | -18 | | | 3 |
| His | His | His | His | His | Pro | Ser | Pro | Pro | Pro | Ser | Gly | Lys | Glu | Trp | | | Gly | Ser | iii | 14 | 109 | | | | | -3 | -8 | | | |
| His | His | His | His | His | Pro | Ser | Pro | Pro | Pro | Ser | Gly | Lys | Glu | Trp | | | | | i | 12 | 110 | | | | | 1 | -1 | | | |
| His | His | His | His | His | Pro | Ser | Pro | Pro | Pro | Gly | | Lys | Glu | TyrGlu | | | | | i | 18 | 111 | | | | | -1 | -10 | | | |
| His | His | His | His | His | Pro | Ser | Pro | Pro | Ser | | | Lys | | | | | | | iii | 14 | 112 | -2 | -13 | -4 | -18 | 5 | -8 | 1 | 1 | |
| His | His | His | His | His | Pro | Ser | Pro | Pro | Pro | Ser | Gly | Lys | Ser | Trp | | | | | i | 16 | 113 | | | | | 0 | -19 | | | |
| His | His | His | His | His | Pro | Ser | Pro | Pro | Ser | Ser | Gly | Lys | Ser | Trp | | | | | i | 16 | 114 | -1 | -13 | -10 | -13 | -4 | -12 | 1 | 1 | 3 |
| His | His | His | His | His | Ala | Ser | Gly | Ser | | | | Lys | | | | Gly | Ser | Gly | i | 18 | 115 | | | | | -1 | -20 | | | |

Figure 1 (Continued)

| Ex | G ref | SEQ ID | Note | 1 | 2 | 3 | 4 | 5 | 6 | 7 | 8 | 9 | 10 | 11 | 12 | 13 | 14 | 15 | 16 | 17 | 18 | 19 | 20 | 21 | 22 | 23 | 24 | 25 | 26 | 27 | 28 | 29 |
|---|---|---|---|---|---|---|---|---|---|---|---|---|---|---|---|---|---|---|---|---|---|---|---|---|---|---|---|---|---|---|---|---|
| 116 | 5238 | 116 | | His | AiB | His | Gly | Thr | Phe | Thr | Ser | Asp | Tyr | Ser | Arg | Tyr | Leu | Asp | Glu | Arg | Arg | Ala | Gln | Glu | Phe | Ile | Glu | Trp | Leu | Leu | His | Gly |
| 117 | 5239 | 117 | | His | AiB | His | Gly | Thr | Phe | Thr | Ser | Asp | Tyr | Ser | Arg | Tyr | Leu | Asp | Gln | Arg | Arg | Ala | Gln | Glu | Phe | Ile | Glu | Trp | Leu | Leu | Ala | Thr |
| 118 | 5240 | 118 | | His | AiB | His | Gly | Thr | Phe | Thr | Ser | Asp | Tyr | Ser | Arg | Tyr | Leu | Asp | Glu | Arg | Arg | Ala | Gln | Glu | Phe | Ile | Glu | Trp | Leu | Leu | His | Gly |
| 119 | 5242 | 119 | | His | AiB | His | Gly | Thr | Phe | Thr | Ser | Asp | Tyr | Ser | Arg | Tyr | Leu | Asp | Gln | Lys | Arg | Ala | His | Glu | Phe | Ile | Glu | Trp | Leu | Leu | Ala | Thr |
| 120 | 5244 | 120 | | His | AiB | His | Gly | Thr | Phe | Thr | Ser | Asp | Tyr | Ser | Lys | Tyr | Leu | Asp | Glu | Lys | Arg | Ala | Gln | Glu | Phe | Ile | Glu | Trp | Leu | Leu | Ala | Ser |
| 121 | 5248 | 121 | | His | AiB | His | Gly | Thr | Phe | Thr | Ser | Asp | Tyr | Ser | Arg | Tyr | Leu | Asp | Glu | Arg | Arg | Ala | Gln | Glu | Phe | Ile | Glu | Trp | Leu | Leu | Ala | Ser |
| 122 | 5249 | 122 | | His | AiB | His | Gly | Thr | Phe | Thr | Ser | Asp | Tyr | Ser | Arg | Tyr | Leu | Asp | Ala | Lys | Arg | Ala | Gln | Glu | Phe | Ile | Glu | Trp | Leu | Leu | Gln | Gly |
| 123 | 5253 | 123 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 124 | 5254 | 124 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 125 | 5256 | 125 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 126 | 5257 | 126 | | His | AiB | His | Gly | Thr | Phe | Thr | Ser | Asp | Tyr | Ser | Lys | Tyr | Leu | Asp | Glu | Arg | Arg | Ala | Gln | Glu | Phe | Ile | Glu | Trp | Leu | Leu | Gln | Ser |
| 127 | 5258 | 127 | | His | AiB | His | Gly | Thr | Phe | Thr | Ser | Asp | Tyr | Ser | Arg | Tyr | Leu | Asp | Gln | Arg | Arg | Ala | Gln | Glu | Phe | Ile | Glu | Trp | Leu | Leu | Gln | Gly |
| 128 | 5262 | 128 | | His | AiB | His | Gly | Thr | Phe | Thr | Ser | Asp | Tyr | Ser | Arg | Tyr | Leu | Asp | Gln | Arg | Arg | Ala | Gln | Glu | Phe | Ile | Glu | Trp | Leu | Leu | Thr | Gly |
| 129 | 5266 | 129 | | His | AiB | His | Gly | Thr | Phe | Thr | Ser | Asp | Tyr | Ser | Arg | Tyr | Leu | Asp | Gln | Arg | Arg | Ala | Gln | Glu | Phe | Ile | Glu | Trp | Leu | Leu | Thr | Gly |
| 130 | 5270 | 130 | | His | AiB | His | Gly | Thr | Phe | Thr | Ser | Asp | Tyr | Ser | Arg | Tyr | Leu | Asp | Gln | Arg | Arg | Ala | Gln | Glu | Phe | Ile | Glu | Trp | Leu | Leu | Thr | Thr |
| 131 | 5271 | 131 | | His | AiB | His | Gly | Thr | Phe | Thr | Ser | Asp | Tyr | Ser | Arg | Tyr | Leu | Asp | Gln | Arg | Arg | Ala | His | Glu | Phe | Ile | Glu | Trp | Leu | Leu | Ala | Thr |
| 132 | 5272 | 132 | | His | AiB | His | Gly | Thr | Phe | Thr | Ser | Asp | Tyr | Ser | Arg | Tyr | Leu | Asp | Gln | Arg | Arg | Ala | His | Glu | Phe | Ile | Glu | Trp | Leu | Leu | Ala | Thr |
| 133 | 5273 | 133 | | His | AiB | His | Gly | Thr | Phe | Thr | Ser | Asp | Tyr | Ser | Arg | Tyr | Leu | Asp | Gln | Arg | Arg | Ala | His | Glu | Phe | Ile | Glu | Trp | Leu | Leu | Ala | Thr |
| 134 | 5274 | 134 | | His | AiB | His | Gly | Thr | Phe | Thr | Ser | Asp | Tyr | Ser | Lys | Tyr | Leu | Asp | Gln | Arg | Arg | Ala | His | Glu | Phe | Ile | Glu | Trp | Leu | Leu | Ala | Thr |
| 135 | 5275 | 135 | | His | AiB | His | Gly | Thr | Phe | Thr | Ser | Asp | Tyr | Ser | Lys | Tyr | Leu | Asp | Ala | Lys | Lys | Ala | His | Glu | Phe | Ile | Glu | Trp | Leu | Leu | Ala | Thr |
| 136 | 5276 | 136 | | His | AiB | His | Gly | Thr | Phe | Thr | Ser | Asp | Tyr | Ser | Lys | Tyr | Leu | Asp | Glu | Lys | Lys | Ala | His | Glu | Phe | Ile | Glu | Trp | Leu | Leu | Ala | Thr |
| 137 | 5277 | 137 | | His | AiB | His | Gly | Thr | Phe | Thr | Ser | Asp | Tyr | Ser | Lys | Tyr | Leu | Asp | Glu | Lys | Lys | Ala | His | Glu | Phe | Ile | Glu | Trp | Leu | Leu | Ala | Thr |
| 138 | 5279 | 138 | | His | AiB | His | Gly | Thr | Phe | Thr | Ser | Asp | Tyr | Ser | Lys | Tyr | Leu | Asp | Glu | Lys | Lys | Ala | Gln | Glu | Phe | Ile | Glu | Trp | Leu | Leu | Ala | Thr |
| 139 | 5280 | 139 | | His | AiB | His | Gly | Thr | Phe | Thr | Ser | Asp | Tyr | Ser | Lys | Tyr | Leu | Asp | Glu | Lys | Lys | Ala | Gln | Glu | Phe | Ile | Glu | Trp | Leu | Leu | Ala | Thr |
| 140 | 5281 | 140 | | His | AiB | His | Gly | Thr | Phe | Thr | Ser | Asp | Tyr | Ser | Arg | Tyr | Leu | Asp | Glu | Arg | Lys | Ala | Gln | Glu | Phe | Ile | Glu | Trp | Leu | Leu | Ala | Thr |
| 141 | 5282 | 141 | | His | AiB | His | Gly | Thr | Phe | Thr | Ser | Asp | Tyr | Ser | Arg | Tyr | Leu | Asp | Glu | Arg | Lys | Ala | Gln | Glu | Phe | Ile | Glu | Trp | Leu | Leu | Ala | Thr |
| 142 | 5283 | 142 | | His | AiB | His | Gly | Thr | Phe | Thr | Ser | Asp | Tyr | Ser | Arg | Tyr | Leu | Asp | Gln | Arg | Lys | Ala | Gln | Glu | Phe | Ile | Glu | Trp | Leu | Leu | Ala | Thr |
| 143 | 5284 | 143 | | His | AiB | His | Gly | Thr | Phe | Thr | Ser | Asp | Tyr | Ser | Arg | Tyr | Leu | Asp | Gln | Arg | Lys | Ala | Gln | Glu | Phe | Ile | Glu | Trp | Leu | Leu | Ala | Thr |
| 144 | 5285 | 144 | | His | AiB | His | Gly | Thr | Phe | Thr | Ser | Asp | Tyr | Ser | Arg | Tyr | Leu | Asp | Glu | Arg | Arg | Ala | His | Glu | Phe | Ile | Glu | Trp | Leu | Leu | Ala | Thr |
| 145 | 5286 | 145 | | His | AiB | His | Gly | Thr | Phe | Thr | Ser | Asp | Tyr | Ser | Arg | Tyr | Leu | Asp | Glu | Lys | Arg | Ala | His | Glu | Phe | Ile | Glu | Trp | Leu | Leu | His | Thr |
| 146 | 5287 | 146 | | His | AiB | His | Gly | Thr | Phe | Thr | Ser | Asp | Tyr | Ser | Arg | Tyr | Leu | Asp | Glu | Lys | Arg | Ala | Gln | Glu | Phe | Ile | Glu | Trp | Leu | Leu | His | Thr |
| 147 | 5288 | 147 | | His | AiB | His | Gly | Thr | Phe | Thr | Ser | Asp | Tyr | Ser | Arg | Tyr | Leu | Asp | Glu | Lys | Arg | Ala | Gln | Glu | Phe | Ile | Glu | Trp | Leu | Leu | His | Thr |
| 148 | 5289 | 148 | | His | AiB | His | Gly | Thr | Phe | Thr | Ser | Asp | Tyr | Ser | Arg | Tyr | Leu | Asp | Glu | Lys | Arg | Ala | Gln | Glu | Phe | Ile | Glu | Trp | Leu | Leu | Ala | Thr |
| 149 | 5290 | 149 | | His | AiB | His | Gly | Thr | Phe | Thr | Ser | Asp | Tyr | Ser | Arg | Tyr | Leu | Asp | Glu | Lys | Arg | Ala | Gln | Glu | Phe | Ile | Glu | Trp | Leu | Leu | Ala | Thr |
| 150 | 5291 | 150 | | His | AiB | His | Gly | Thr | Phe | Thr | Ser | Asp | Tyr | Ser | Arg | Tyr | Leu | Asp | Glu | Lys | Arg | Ala | Gln | Glu | Phe | Ile | Glu | Trp | Leu | Leu | Ala | Thr |
| 151 | 5292 | 151 | | His | AiB | His | Gly | Thr | Phe | Thr | Ser | Asp | Tyr | Ser | Arg | Tyr | Leu | Asp | Glu | Lys | Arg | Ala | Gln | Glu | Phe | Ile | Glu | Trp | Leu | Leu | Ala | Thr |
| 152 | 5293 | 152 | | His | AiB | His | Gly | Thr | Phe | Thr | Ser | Asp | Tyr | Ser | Arg | Tyr | Leu | Asp | Glu | Lys | Arg | Ala | Gln | Glu | Phe | Ile | Glu | Trp | Leu | Leu | Ala | Thr |
| 153 | 5295 | 153 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |

Figure 1 (Continued)

| 30 | 31 | 32 | 33 | 34 | 35 | 36 | 37 | 38 | 39 | 40 | 41 | 42 | 43 | 44 | 45 | 46 | 47 | 48 | Z | n (R=Cn) | Ex | 7.5nM single intake | loss | 15nM single intake | loss | 30nM single intake | loss | rpt dose | Ratio Gluc/GLP-1 |
|---|---|---|---|---|---|---|---|---|---|---|---|---|---|---|---|---|---|---|---|---|---|---|---|---|---|---|---|---|---|
| His | His | His | His | His | Ser | Gly | Glu | Gly | | | | | | | Gly | Ser | Gly | Ser | i | 18 | 116 | -8 | | 0 | 0 | 4 | -18 | | 4 |
| His | His | His | His | His | Ser | Gly | Glu | Gly | | | | Lys | | | Gly | Ser | Gly | Ser | i | 18 | 117 | | -7 | | | -5 | -12 | | |
| His | His | His | His | His | Pro | Ser | Gly | | | | | Lys | | | Gly | Ser | Gly | Ser | i | 18 | 118 | | | | | 1 | -14 | | |
| His | His | His | His | His | Pro | Ser | Gly | | | | | Lys | | | Gly | Ser | Gly | Ser | i | 18 | 119 | | | | | -2 | -16 | | |
| His | His | His | His | His | Pro | Ser | Gly | | | | | Lys | | | Gly | Ser | Gly | Ser | i | 18 | 120 | | | | | -10 | -13 | | |
| His | His | His | His | His | Pro | Ser | Pro | Pro | Pro | | | Lys | | | Gly | Ser | Gly | Ser | i | 18 | 121 | | | | | -1 | -10 | 1 | 2 |
| His | His | His | His | His | Pro | Ser | Gly | | | Gly | | Lys | | | Gly | Ser | Gly | Ser | i | 18 | 122 | | | | | | | 8 | 4 |
| His | His | His | His | His | Ser | Gly | Gly | | | | | Lys | | | | Ser | Gly | Thr | i | 16 | 123 | | | | | 0 | -13 | | |
| His | His | His | His | His | Ser | Gly | Gly | Gly | | | | Lys | | | | Ser | Gly | Thr | i | 14 | 124 | | | | | -1 | -9 | | |
| His | His | His | His | His | Pro | Gly | Gly | Gly | | | | Lys | | | | | | Asn | i | 16 | 125 | | | | | -9 | -17 | | |
| His | His | His | His | His | Pro | Gly | Gly | Gly | | | | Lys | | | Gly | Ser | Ser | Gly | i | 14 | 126 | | | | | -5 | -12 | | |
| His | His | His | His | His | Ala | Ser | Gly | Ser | | | | Lys | | | | Ser | Gly | Thr | i | 14 | 127 | | | | | -4 | -13 | | |
| His | His | His | His | His | Ala | Ser | Gly | Ser | | | | Lys | | | | | Gly | Thr | i | 14 | 128 | | | | | -7 | -14 | | |
| His | His | His | His | His | Ala | Ser | Gly | Ser | | | | Lys | | | | | Gly | Thr | i | 18 | 129 | | | | | -6 | -17 | | |
| His | His | His | His | His | Ala | Ser | Gly | Ser | | | | Lys | | | | | Thr | His | i | 14 | 130 | | | | | 18 | -4 | | |
| His | His | His | His | His | Pro | Ser | Pro | Pro | Pro | Gly | | Lys | | | | | Gly | Thr | i | 14 | 131 | | | | | 0 | -17 | | |
| His | His | His | His | His | Pro | Ser | Pro | Pro | Pro | Gly | | Lys | | | Ser | Ser | Gly | Asn | i | 16 | 132 | -3 | -11 | -2 | -14 | -1 | -20 | | |
| His | His | His | His | His | Pro | Ser | Pro | Pro | Pro | Gly | | Lys | | | | | | | i | 18 | 133 | | | | | -6 | -17 | 2 | 2 |
| His | His | His | His | His | Pro | Ser | Pro | Pro | Pro | Gly | | Lys | | | | | Gly | Ser | i | 18 | 134 | | | | | -4 | -17 | | |
| His | His | His | His | His | Pro | Ser | Pro | Pro | Pro | Gly | | Lys | | | | | Thr | His | i | 18 | 135 | | | | | -1 | -15 | | |
| His | His | His | His | His | Pro | Ser | Pro | Pro | Pro | Gly | | Lys | | | | | Thr | His | i | 18 | 136 | | | -3 | -15 | 0 | -18 | | |
| His | His | His | His | His | Pro | Ser | Pro | Pro | Pro | Gly | | Lys | | | Thr | Thr | Thr | i | 18 | 137 | | | | | -11 | -23 | | |
| His | His | His | His | His | Ala | Ser | Pro | Pro | Pro | | | Lys | | | | Ser | Gly | Thr | i | 18 | 138 | | | | | -10 | -16 | | 3 |
| His | His | His | His | His | Ala | Ser | Pro | Pro | Pro | | | Lys | | | | | Thr | Asn | i | 18 | 139 | | | | | -2 | -16 | | 1 |
| His | His | His | His | His | Ala | Ser | Pro | Pro | Pro | | | Lys | | | | | Gly | Thr | i | 18 | 140 | | | | | -9 | -16 | | |
| His | His | His | His | His | Ala | Ser | Gly | | | | | Lys | | | Gly | Ser | | His | i | 18 | 141 | | | 4 | -11 | -3 | -19 | | |
| His | His | His | His | His | Ala | Ser | Gly | | | | | Lys | | | | | Gly | Ser | i | 18 | 142 | | | | | 5 | -12 | | |
| His | His | His | His | His | Ala | Ser | Gly | | | | | Lys | | | | | Thr | Thr | i | 18 | 143 | | | | | -3 | -15 | | |
| His | His | His | His | His | Pro | Ser | Gly | | | | | Lys | | | | Ser | Gly | Asn | i | 18 | 144 | | | | | 0 | -18 | | 1 |
| His | His | His | His | His | Pro | Ser | Gly | | | | | Lys | | | | | Thr | Thr | i | 18 | 145 | | | | | -2 | -15 | | |
| His | His | His | His | His | Pro | Ser | Gly | | | | | Lys | | | | Ser | Gly | His | i | 18 | 146 | | | | | 0 | -12 | | |
| His | His | His | His | His | Pro | Ser | Gly | | | | | Lys | | | | | Gly | Ser | i | 18 | 147 | | | | | 11 | -16 | | |
| His | His | His | His | His | Pro | Ser | Gly | | | | | Lys | | | | | | Asn | i | 18 | 148 | | -2 | -7 | 1 | -18 | | 3 |
| His | His | His | His | His | Pro | Ser | Gly | | | | | Lys | | | | | Gly | Thr | i | 18 | 149 | | | | | 3 | -16 | | |
| His | His | His | His | His | Pro | Ser | Gly | | | | | Lys | | | | | Thr | His | i | 18 | 150 | | | | | 3 | -16 | | |
| His | His | His | His | His | Pro | Ser | Gly | | | | | Lys | | | Gly | Ser | Gly | Ser | i | 14 | 151 | | | -4 | -16 | -4 | -18 | | |
| His | His | His | His | His | Pro | Ser | Gly | | | | | Lys | | | | | Gly | Thr | i | 18 | 152 | | | | | -7 | -13 | | |
| His | His | His | His | His | Ser | Gly | Glu | Gly | | | | Lys | | | | | Thr | His | i | 18 | 153 | | | | | 4 | -10 | | |

| Ex | G ref | SEQ ID | Note | 1 | 2 | 3 | 4 | 5 | 6 | 7 | 8 | 9 | 10 | 11 | 12 | 13 | 14 | 15 | 16 | 17 | 18 | 19 | 20 | 21 | 22 | 23 | 24 | 25 | 26 | 27 | 28 | 29 |
|---|---|---|---|---|---|---|---|---|---|---|---|---|---|---|---|---|---|---|---|---|---|---|---|---|---|---|---|---|---|---|---|---|
| 154 | 5297 | 154 | | His | AIB | His | Gly | Thr | Phe | Thr | Ser | Asp | Tyr | Ser | Lys | Tyr | Leu | Asp | Ser | Arg | Arg | Ala | Gln | Asp | Phe | Val | Gln | Trp | Leu | Leu | Asn | Thr |
| 155 | 5301 | 155 | | His | AIB | His | Gly | Thr | Phe | Thr | Ser | Asp | Tyr | Ser | Arg | Tyr | Leu | Asp | Gln | Arg | Arg | Ala | Gln | Glu | Phe | Val | Gln | Trp | Leu | Leu | Ala | Thr |
| 156 | 5318 | 156 | | His | AIB | His | Gly | Thr | Phe | Thr | Ser | Asp | Tyr | Ser | Arg | Tyr | Leu | Asp | Gln | Lys | Arg | Ala | Gln | Glu | Phe | Ile | Glu | Trp | Leu | Leu | Ala | Thr |
| 157 | 5332 | 157 | | His | AIB | His | Gly | Thr | Phe | Thr | Ser | Asp | Tyr | Ser | Arg | Tyr | Leu | Asp | Ala | Lys | Arg | Ala | Gln | Glu | Phe | Ile | Glu | Trp | Leu | Leu | Gln | Ser |
| 158 | 5333 | 158 | | His | AIB | His | Gly | Thr | Phe | Thr | Ser | Asp | Tyr | Ser | Arg | Tyr | Leu | Asp | Ala | Lys | Arg | Ala | Gln | Glu | Phe | Ile | Glu | Trp | Leu | Leu | Gln | Ser |
| 159 | 5334 | 159 | | His | AIB | His | Gly | Thr | Phe | Thr | Ser | Asp | Tyr | Ser | Arg | Tyr | Leu | Asp | Ala | Lys | Arg | Ala | Gln | Glu | Phe | Ile | Glu | Trp | Leu | Leu | Gln | Ser |
| 160 | 5335 | 160 | | His | AIB | His | Gly | Thr | Phe | Thr | Ser | Asp | Tyr | Ser | Arg | Tyr | Leu | Asp | Ala | Lys | Arg | Ala | Gln | Glu | Phe | Ile | Glu | Trp | Leu | Leu | Gln | Ser |
| 161 | 5336 | 161 | | His | AIB | His | Gly | Thr | Phe | Thr | Ser | Asp | Tyr | Ser | Arg | Tyr | Leu | Asp | Ala | Lys | Arg | Ala | Gln | Glu | Phe | Ile | Glu | Trp | Leu | Leu | Gln | Ser |
| 162 | 5337 | 162 | | His | AIB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 163 | 5339 | 163 | | His | AIB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 164 | 5340 | 164 | | His | AIB | His | Gly | Thr | Phe | Thr | Ser | Asp | Tyr | Ser | Arg | Tyr | Leu | Asp | Ala | Arg | Arg | Ala | Gln | Glu | Phe | Ile | Glu | Trp | Leu | Leu | Gln | Ser |
| 165 | 5341 | 165 | | His | AIB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Ala | Thr |
| 166 | 5342 | 166 | | His | AIB | His | Gly | Thr | Phe | Thr | Ser | Asp | Tyr | Ser | Arg | Tyr | Leu | Asp | Gln | Arg | Arg | Ala | Gln | Glu | Phe | Ile | Glu | Trp | Leu | Leu | Gln | Ser |
| 167 | 5343 | 167 | | His | AIB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 168 | 5344 | 168 | | His | AIB | His | Gly | Thr | Phe | Thr | Ser | Asp | Tyr | Ser | Arg | Tyr | Leu | Asp | Ala | Arg | Arg | Ala | Gln | Glu | Phe | Ile | Glu | Trp | Leu | Leu | Gln | Ser |
| 169 | 5345 | 169 | | His | AIB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | His | Gly |
| 170 | 5346 | 170 | | His | AIB | His | Gly | Thr | Phe | Thr | Ser | Asp | Tyr | Ser | Arg | Tyr | Leu | Asp | Glu | Arg | Arg | Ala | Gln | Glu | Phe | Ile | Glu | Trp | Leu | Leu | His | Gly |
| 171 | 5347 | 171 | | His | AIB | His | Gly | Thr | Phe | Thr | Ser | Asp | Tyr | Ser | Lys | Tyr | Leu | Asp | Glu | Arg | Arg | Ala | Gln | Glu | Phe | Ile | Glu | Trp | Leu | Leu | Asn | Ser |
| 172 | 5348 | 172 | | His | AIB | His | Gly | Thr | Phe | Thr | Ser | Asp | Tyr | Ser | Arg | Tyr | Leu | Asp | Gln | Arg | Arg | Ala | Gln | Glu | Phe | Ile | Glu | Trp | Leu | Leu | Asn | Ser |
| 173 | 5349 | 173 | | His | AIB | His | Gly | Thr | Phe | Thr | Ser | Asp | Tyr | Ser | Arg | Tyr | Leu | Asp | Gln | Lys | Arg | Ala | Gln | Glu | Phe | Ile | Glu | Trp | Leu | Leu | Ala | Thr |
| 174 | 5350 | 174 | | His | AIB | His | Gly | Thr | Phe | Thr | Ser | Asp | Tyr | Ser | Arg | Tyr | Leu | Asp | Ala | Arg | Arg | Ala | Gln | Glu | Phe | Ile | Glu | Trp | Leu | Leu | Ala | Thr |
| 175 | 5351 | 175 | | His | AIB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Ala | Thr |
| 176 | 5354 | 176 | | His | AIB | His | Gly | Thr | Phe | Thr | Ser | Asp | Tyr | Ser | Arg | Tyr | Leu | Asp | Ala | Arg | Arg | Ala | Gln | Glu | Phe | Ile | Glu | Trp | Leu | Leu | Gln | Ser |
| 177 | 5355 | 177 | Dup Ex107 | His | AIB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 178 | 5358 | 178 | | His | AIB | His | Gly | Thr | Phe | Thr | Ser | Asp | Tyr | Ser | Arg | Tyr | Leu | Asp | Ala | Lys | Arg | Ala | Gln | Glu | Phe | Ile | Glu | Trp | Leu | Leu | Gln | Ser |
| 179 | 5362 | 179 | Dup Ex 46 | His | AIB | His | Gly | Thr | Phe | Thr | Ser | Asp | Tyr | Ser | Arg | Tyr | Leu | Asp | Ala | Lys | Arg | Ala | Gln | Glu | Phe | Ile | Glu | Trp | Leu | Leu | Gln | Ser |
| 180 | 5363 | 180 | Dup Ex 50 | His | AIB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 181 | 5364 | 181 | | His | AIB | His | Gly | Thr | Phe | Thr | Ser | Asp | Tyr | Ser | Arg | Tyr | Leu | Asp | Ala | Lys | Arg | Ala | Gln | Glu | Phe | Ile | Glu | Trp | Leu | Leu | His | Gly |
| 182 | 5365 | 182 | | His | AIB | His | Gly | Thr | Phe | Thr | Ser | Asp | Tyr | Ser | Arg | Tyr | Leu | Asp | Ala | Lys | Lys | Ala | Gln | Glu | Phe | Ile | Glu | Trp | Leu | Leu | Ala | Ser |
| 183 | 5366 | 183 | | His | AIB | His | Gly | Thr | Phe | Thr | Ser | Asp | Tyr | Ser | Arg | Tyr | Leu | Asp | Ala | Lys | Arg | Ala | His | Glu | Phe | Ile | Glu | Trp | Leu | Leu | Asn | Thr |
| 184 | 5367 | 184 | | His | AIB | His | Gly | Thr | Phe | Thr | Ser | Asp | Tyr | Ser | Arg | Tyr | Leu | Asp | Ala | Lys | Arg | Ala | Gln | Glu | Phe | Ile | Glu | Trp | Leu | Leu | Gln | Gly |
| 185 | 5368 | 185 | | His | AIB | His | Gly | Thr | Phe | Thr | Ser | Asp | Tyr | Ser | Arg | Tyr | Leu | Asp | Ala | Lys | Arg | Ala | Gln | Glu | Phe | Ile | Glu | Trp | Leu | Leu | Asn | Gly |
| 186 | 5369 | 186 | | His | AIB | His | Gly | Thr | Phe | Thr | Ser | Asp | Tyr | Ser | Arg | Tyr | Leu | Asp | Ala | Lys | Arg | Ala | Gln | Glu | Phe | Ile | Glu | Trp | Leu | Leu | Gln | Thr |
| 187 | 5370 | 187 | | His | AIB | His | Gly | Thr | Phe | Thr | Ser | Asp | Tyr | Ser | Arg | Tyr | Leu | Asp | Ala | Lys | Arg | Ala | Gln | Glu | Phe | Ile | Glu | Trp | Leu | Leu | Ala | Ser |
| 188 | 5371 | 188 | | His | AIB | His | Gly | Thr | Phe | Thr | Ser | Asp | Tyr | Ser | Arg | Tyr | Leu | Asp | Ala | Lys | Arg | Ala | Gln | Glu | Phe | Ile | Glu | Trp | Leu | Leu | Asn | Thr |
| 189 | 5372 | 189 | | His | AIB | His | Gly | Thr | Phe | Thr | Ser | Asp | Tyr | Ser | Arg | Tyr | Leu | Asp | Ala | Lys | Arg | Ala | Gln | Glu | Phe | Ile | Glu | Trp | Leu | Leu | Gln | Gly |
| 190 | 5373 | 190 | | His | AIB | His | Gly | Thr | Phe | Thr | Ser | Asp | Tyr | Ser | Arg | Tyr | Leu | Asp | Glu | Arg | Arg | Ala | Gln | Glu | Phe | Ile | Glu | Trp | Leu | Leu | Ala | Thr |
| 191 | 5374 | 191 | | His | AIB | His | Gly | Thr | Phe | Thr | Ser | Asp | Tyr | Ser | Arg | Tyr | Leu | Asp | Glu | Arg | Arg | Ala | Gln | Glu | Phe | Ile | Glu | Trp | Leu | Leu | Gln | Ser |

Figure 1 (Continued)

| 30 | 31 | 32 | 33 | 34 | 35 | 36 | 37 | 38 | 39 | 40 | 41 | 42 | 43 | 44 | 45 | 46 | 47 | 48 | Z | n (R=$C_n$) | Ex | 7.5nM single | | 15nM single | | 30nM single | | rpt dose | | Ratio |
|----|----|----|----|----|----|----|----|----|----|----|----|----|----|----|----|----|----|----|---|---|----|---|---|---|---|---|---|---|---|---|
| | | | | | | | | | | | | | | | | | | | | | | intake | loss | intake | loss | intake | loss | | | Gluc/GLP-1 |
| His | His | His | His | His | Ser | Gly | Glu | Gly | | | | | | | Gly | Ser | Gly | Ser | i | 18 | 154 | | | | | 0 | -13 | | | |
| His | His | His | His | His | Pro | Ser | Glu | Gly | | | | | | | Gly | Ser | Gly | Ser | i | 18 | 155 | -4 | -5 | | | -12 | -21 | | | 3 |
| His | His | His | His | His | Pro | Ser | Gly | | | | | | | | | | | | iii | 16 | 156 | | | | | 14 | -5 | | | |
| His | His | His | His | His | Pro | Ser | Pro | Pro | Pro | Gly | | Lys | | | | | Gly | Ser | i | 18 | 157 | -4 | -8 | 6 | -16 | -8 | -26 | 4 | 5 | 2 |
| His | His | His | His | His | Pro | Ser | Pro | Pro | Pro | Gly | | Lys | | | | | Gly | Ser | i | 14 | 158 | | | | | 4 | -9 | 8 | 8 | 3 |
| His | His | His | His | His | Pro | Ser | Pro | Pro | Pro | Gly | | Lys | | | | Ser | Gly | Thr | i | 18 | 159 | -9 | -15 | | | 7 | -18 | 1 | 1 | 2 |
| His | His | His | His | His | Pro | Ser | Pro | Pro | Pro | Gly | | Lys | | | Thr | Gly | Ser | Gly | i | 16 | 160 | 2 | -9 | | | -12 | -20 | 8 | 9 | 5 |
| His | His | His | His | His | Pro | Ser | Pro | Pro | Pro | Gly | | Lys | | | | | | | iii | 14 | 161 | | | | | 15 | -7 | | | |
| His | His | His | His | His | Pro | Ser | Pro | Pro | Pro | Gly | | Lys | | | | | | | iii | 18 | 162 | | | | | 8 | -14 | | | |
| His | His | His | His | His | Glu | Ser | Pro | Pro | Pro | Gly | | Lys | | | | | Gly | Ser | i | 16 | 163 | | | | | 22 | -7 | | | |
| His | His | His | His | His | Glu | Ser | Pro | Pro | Pro | Ser | Gly | Lys | Ser | Trp | | | Gly | Ser | i | 18 | 164 | 0 | -11 | -2 | -18 | -13 | -22 | 5 | 6 | 4 |
| His | His | His | His | His | Glu | Ser | Pro | Pro | Pro | Ser | Gly | Lys | Ser | Trp | Gly | Ser | Gly | Ser | i | 18 | 165 | -9 | -10 | -1 | -16 | 7 | -15 | 4 | 4 | 3 |
| His | His | His | His | His | Glu | Ser | Gly | | | | | Lys | | | | | | | iii | 14 | 166 | | | | | -6 | -15 | | | |
| His | His | His | His | His | Glu | Ser | Pro | Pro | Pro | Gly | | Lys | | | | | | | iii | 16 | 167 | | | | | 3 | -15 | | | |
| His | His | His | His | His | Pro | Ser | Pro | Pro | Pro | Gly | | Lys | | | | Ser | Gly | Thr | i | 18 | 168 | 0 | -10 | -4 | -20 | -6 | -20 | 4 | 4 | 3 |
| His | His | His | His | His | Pro | Ser | Pro | Pro | Pro | Gly | | Lys | | | | Ser | Gly | Ser | i | 18 | 169 | -14 | -4 | 0 | 0 | -13 | -22 | 2 | 2 | 3 |
| His | His | His | His | His | Pro | Ser | Pro | Pro | Pro | Gly | | Lys | | | Thr | Gly | Thr | His | i | 18 | 170 | -5 | -8 | 0 | -13 | -4 | -23 | 1 | 1 | 3 |
| His | His | His | His | His | Pro | Ser | Pro | Pro | Pro | Gly | | Lys | | | Thr | Gly | Ser | Gly | i | 16 | 171 | 1 | -7 | -2 | | -9 | -24 | 1 | 1 | 3 |
| His | His | His | His | His | Pro | Ser | Pro | Pro | Pro | Gly | | Lys | | | Thr | Gly | Ser | His | i | 18 | 172 | -3 | -8 | -4 | | 2 | -12 | | | |
| His | His | His | His | His | Pro | Ser | Pro | Pro | Pro | Gly | | Lys | | | Thr | Gly | Gly | Ser | i | 18 | 173 | 0 | -11 | 0 | | -4 | -16 | | | |
| His | His | His | His | His | Ser | Ser | Glu | Gly | | | | Lys | | | Gly | Ser | Gly | Ser | i | 16 | 174 | -1 | -10 | -1 | -20 | -2 | -19 | 7 | 7 | 6 |
| His | His | His | His | His | Ser | Ser | Glu | Gly | | | | Lys | | | | | Gly | Ser | i | 16 | 175 | -7 | -12 | -6 | -13 | -7 | -20 | 4 | 4 | 4 |
| His | His | His | His | His | Pro | Gly | Glu | Gly | | | | Lys | | | | | Gly | Ser | i | 16 | 176 | | | 3 | -19 | 0 | -20 | | | 3 |
| His | His | His | His | His | Ser | Gly | Glu | Gly | | | | Lys | | | | | Gly | Ser | i | 18 | 177 | | | -17 | -19 | -12 | -30 | | | 3 |
| His | His | His | His | His | Ser | Gly | Pro | Gly | | | | Lys | | | Gly | Ser | Gly | Ser | i | 16 | 178 | | | -17 | -19 | | | | | |
| His | His | His | His | His | Ser | Gly | Pro | Pro | Pro | Gly | | Lys | | | | | Gly | Ser | i | 16 | 179 | | | -7 | -17 | | | | | |
| His | His | His | His | His | Ser | Ser | Pro | Pro | Pro | Gly | | Lys | | | | | Gly | Ser | i | 18 | 180 | | | -7 | -18 | | | | | |
| His | His | His | His | His | Ser | Gly | Glu | Gly | | | | Lys | | | Gly | Ser | Gly | Ser | i | 16 | 181 | | | -14 | -15 | | | | | |
| His | His | His | His | His | Ser | Gly | Glu | Gly | | | | Lys | | | | | Gly | Ser | i | 16 | 182 | | | -23 | -20 | | | | | 4 |
| His | His | His | His | His | Ser | Ser | Glu | | | | | Lys | | | | | Gly | Ser | i | 16 | 183 | -4 | -12 | 5 | -10 | | | 7 | 7 | |
| His | His | His | His | His | Pro | Ser | Glu | Gly | | | | Lys | | | | | Thr | His | i | 16 | 184 | -10 | -12 | -7 | -16 | | | 4 | 4 | 4 |
| His | His | His | His | His | Pro | Ser | Pro | Pro | Pro | Gly | | Lys | | | | | Thr | His | i | 16 | 185 | -3 | -12 | -4 | -18 | | | 3 | 4 | |
| His | His | His | His | His | Pro | Ser | Pro | Pro | Pro | | | Lys | | | | | Gly | Ser | i | 16 | 186 | | | | -15 | | | | | |
| His | His | His | His | His | Pro | Ser | Pro | Pro | Pro | Gly | | Lys | | | | | Gly | Ser | i | 16 | 187 | | | | -20 | | | | | 3 |
| His | His | His | His | His | Pro | Ser | Pro | Pro | Pro | Gly | | Lys | | | Gly | Ser | Gly | Ser | i | 16 | 188 | | | | -10 | | | | | |
| His | His | His | His | His | Pro | Ser | Pro | Pro | Pro | Gly | | Lys | | | | | Thr | His | i | 16 | 189 | | | | -16 | | | | | |
| His | His | His | His | His | Pro | Ser | Pro | Pro | Pro | Gly | | Lys | | | | | Gly | Ser | i | 16 | 190 | -1 | -16 | -4 | -18 | | | 2 | 2 | 5 |
| His | His | His | His | His | Pro | Ser | Pro | Pro | Pro | Gly | | Lys | | | | | Thr | His | i | 18 | 191 | -12 | -7 | -1 | -17 | | | 1 | 1 | |

Figure 1 (Continued)

| Ex | G ref | SEQ ID | Note | 1 | 2 | 3 | 4 | 5 | 6 | 7 | 8 | 9 | 10 | 11 | 12 | 13 | 14 | 15 | 16 | 17 | 18 | 19 | 20 | 21 | 22 | 23 | 24 | 25 | 26 | 27 | 28 | 29 |
|---|---|---|---|---|---|---|---|---|---|---|---|---|---|---|---|---|---|---|---|---|---|---|---|---|---|---|---|---|---|---|---|---|
| 192 | 5375 | 192 | | His | AIB | His | Gly | Thr | Phe | Thr | Ser | Asp | Tyr | Ser | Arg | Tyr | Leu | Asp | Glu | Lys | Arg | Ala | Gln | Glu | Phe | Ile | Glu | Trp | Leu | Leu | Ala | Ser |
| 193 | 5376 | 193 | | His | AIB | His | Gly | Thr | Phe | Thr | Ser | Asp | Tyr | Ser | Arg | Tyr | Leu | Asp | Glu | Arg | Arg | Ala | Gln | Glu | Phe | Ile | Glu | Trp | Leu | Leu | Ala | Ser |
| 194 | 5377 | 194 | | His | AIB | His | Gly | Thr | Phe | Thr | Ser | Asp | Tyr | Ser | Lys | Tyr | Leu | Asp | Glu | Lys | Arg | Ala | Gln | Glu | Phe | Ile | Glu | Trp | Leu | Leu | Ala | Ser |
| 195 | 5378 | 195 | | His | AIB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Ala | Ser |
| 196 | 5379 | 196 | | His | AIB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 197 | 5380 | 197 | | His | AIB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 198 | 5381 | 198 | | His | AIB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 199 | 5382 | 199 | | His | AIB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 200 | 5383 | 200 | | His | AIB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 201 | 5384 | 201 | | His | AIB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 202 | 5385 | 202 | | His | AIB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 203 | 5386 | 203 | | His | AIB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 204 | 5387 | 204 | | His | AIB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Ala | Ser |
| 205 | 5388 | 205 | | His | AIB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | His | Ser |
| 206 | 5389 | 206 | | His | AIB | His | Gly | Thr | Phe | Thr | Ser | Asp | Tyr | Ser | Lys | Tyr | Leu | Asp | Glu | Lys | Arg | Ala | His | Glu | Phe | Ile | Glu | Trp | Leu | Leu | Gln | Gly |
| 207 | 5390 | 207 | | His | AIB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | His | Ser |
| 208 | 5391 | 208 | | His | AIB | His | Gly | Thr | Phe | Thr | Ser | Asp | Tyr | Ser | Lys | Tyr | Leu | Asp | Gly | Lys | Arg | Ala | His | Glu | Phe | Ile | Glu | Trp | Leu | Leu | Gln | Gly |
| 209 | 5392 | 209 | | His | AIB | His | Gly | Thr | Phe | Thr | Ser | Asp | Tyr | Ser | Lys | Tyr | Leu | Asp | Glu | Lys | Arg | Ala | Gln | Glu | Phe | Ile | Glu | Trp | Leu | Leu | His | Gly |
| 210 | 5393 | 210 | | His | AIB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 211 | 5394 | 211 | | His | AIB | His | Gly | Thr | Phe | Thr | Ser | Asp | Tyr | Ser | Arg | Tyr | Leu | Asp | Gln | Arg | Arg | Ala | Gln | Glu | Phe | Ile | Glu | Trp | Leu | Leu | Ala | Ser |
| 212 | 5395 | 212 | | His | AIB | His | Gly | Thr | Phe | Thr | Ser | Asp | Tyr | Ser | Arg | Tyr | Leu | Asp | Gln | Arg | Arg | Ala | Gln | Glu | Phe | Ile | Glu | Trp | Leu | Leu | Ala | Ser |
| 213 | 5396 | 213 | | His | AIB | His | Gly | Thr | Phe | Thr | Ser | Asp | Tyr | Ser | Arg | Tyr | Leu | Asp | Gln | Arg | Arg | Ala | Gln | Glu | Phe | Ile | Glu | Trp | Leu | Leu | Gln | Ser |
| 214 | 5397 | 214 | | His | AIB | His | Gly | Thr | Phe | Thr | Ser | Asp | Tyr | Ser | Arg | Tyr | Leu | Asp | Gln | Lys | Arg | Ala | Gln | Glu | Phe | Ile | Glu | Trp | Leu | Leu | Ala | Thr |
| 215 | 5398 | 215 | | His | AIB | His | Gly | Thr | Phe | Thr | Ser | Asp | Tyr | Ser | Arg | Tyr | Leu | Asp | Ala | Lys | Arg | Ala | Gln | Glu | Phe | Ile | Glu | Trp | Leu | Leu | Ala | Thr |
| 216 | 5399 | 216 | | His | AIB | His | Gly | Thr | Phe | Thr | Ser | Asp | Tyr | Ser | Arg | Tyr | Leu | Asp | Ala | Arg | Arg | Ala | Gln | Glu | Phe | Ile | Glu | Trp | Leu | Leu | Ala | Thr |
| 217 | 5400 | 217 | | His | AIB | His | Gly | Thr | Phe | Thr | Ser | Asp | Tyr | Ser | Arg | Tyr | Leu | Asp | Ala | Lys | Arg | Ala | Gln | Glu | Phe | Ile | Glu | Trp | Leu | Leu | Gln | Ser |
| 218 | 5401 | 218 | | His | AIB | His | Gly | Thr | Phe | Thr | Ser | Asp | Tyr | Ser | Arg | Tyr | Leu | Asp | Ala | Lys | Arg | Ala | Gln | Glu | Phe | Ile | Glu | Trp | Leu | Leu | Ala | Thr |
| 219 | 5402 | 219 | | His | AIB | His | Gly | Thr | Phe | Thr | Ser | Asp | Tyr | Ser | Arg | Tyr | Leu | Asp | Gly | Lys | Arg | Ala | Gln | Glu | Phe | Ile | Glu | Trp | Leu | Leu | Thr | Gly |
| 220 | 5403 | 220 | | His | AIB | His | Gly | Thr | Phe | Thr | Ser | Asp | Tyr | Ser | Arg | Tyr | Leu | Asp | Ala | Arg | Arg | Ala | His | Glu | Phe | Ile | Glu | Trp | Leu | Leu | Ala | Gly |
| 221 | 5404 | 221 | | His | AIB | His | Gly | Thr | Phe | Thr | Ser | Asp | Tyr | Ser | Arg | Tyr | Leu | Asp | Ala | Lys | Arg | Ala | Gln | Glu | Phe | Ile | Glu | Trp | Leu | Leu | Ala | Gly |
| 222 | 5405 | 222 | | His | AIB | His | Gly | Thr | Phe | Thr | Ser | Asp | Tyr | Ser | Arg | Tyr | Leu | Asp | Ala | Lys | Arg | Ala | His | Glu | Phe | Ile | Glu | Trp | Leu | Leu | Ala | Gly |
| 223 | 5406 | 223 | | His | AIB | His | Gly | Thr | Phe | Thr | Ser | Asp | Tyr | Ser | Arg | Tyr | Leu | Asp | Ala | Lys | Arg | Ala | His | Glu | Phe | Ile | Glu | Trp | Leu | Leu | Thr | Gly |
| 224 | 5407 | 224 | | His | AIB | His | Gly | Thr | Phe | Thr | Ser | Asp | Tyr | Ser | Arg | Tyr | Leu | Asp | Ala | Arg | Arg | Ala | His | Glu | Phe | Ile | Glu | Trp | Leu | Leu | Ala | Gly |
| 225 | 5408 | 225 | | His | AIB | His | Gly | Thr | Phe | Thr | Ser | Asp | Tyr | Ser | Arg | Tyr | Leu | Asp | Ala | Lys | Arg | Ala | His | Glu | Phe | Ile | Glu | Trp | Leu | Leu | His | Gly |
| 226 | 5409 | 226 | | His | AIB | His | Gly | Thr | Phe | Thr | Ser | Asp | Tyr | Ser | Lys | Tyr | Leu | Asp | Ala | Lys | Arg | Ala | His | Glu | Phe | Ile | Glu | Trp | Leu | Leu | His | Gly |
| 227 | 5410 | 227 | | His | AIB | His | Gly | Thr | Phe | Thr | Ser | Asp | Tyr | Ser | Lys | Tyr | Leu | Asp | Ala | Lys | Arg | Ala | His | Glu | Phe | Ile | Glu | Trp | Leu | Leu | His | Gly |
| 228 | 5411 | 228 | | His | AIB | His | Gly | Thr | Phe | Thr | Ser | Asp | Tyr | Ser | Lys | Tyr | Leu | Asp | Ala | Lys | Arg | Ala | His | Glu | Phe | Ile | Glu | Trp | Leu | Leu | His | Gly |
| 229 | 5412 | 229 | | His | AIB | His | Gly | Thr | Phe | Thr | Ser | Asp | Tyr | Ser | Arg | Tyr | Leu | Asp | Glu | Lys | Arg | Ala | His | Glu | Phe | Ile | Glu | Trp | Leu | Leu | His | Gly |

Figure 1 (Continued)

| 30 | 31 | 32 | 33 | 34 | 35 | 36 | 37 | 38 | 39 | 40 | 41 | 42 | 43 | 44 | 45 | 46 | 47 | 48 | Z | n (R=C$_n$) | Ex | 7.5nM single intake | 7.5nM single loss | 15nM single intake | 15nM single loss | 30nM single intake | 30nM single loss | rpt dose intake | rpt dose loss | Ratio Gluc/GLP-1 |
|---|---|---|---|---|---|---|---|---|---|---|---|---|---|---|---|---|---|---|---|---|---|---|---|---|---|---|---|---|---|---|
| His | His | His | His | His | Pro | Ser | Pro | Pro | Pro | Gly | | Lys | | | | | Thr | His | i | 18 | 192 | | | 3 | -8 | | | | | |
| His | His | His | His | His | Pro | Ser | Pro | Pro | Pro | Gly | | Lys | | | | Ser | Gly | Thr | i | 18 | 193 | -3 | -5 | 5 | -18 | | | | | 6 |
| His | His | His | His | His | Pro | Ser | Pro | Pro | Pro | Gly | | Lys | | | | | Thr | His | i | 18 | 194 | | | -13 | -17 | | | | | 5 |
| His | His | His | His | His | Pro | Ser | Pro | Pro | Pro | Gly | | Lys | | | | Ser | Asn | Thr | i | 18 | 195 | | | -19 | -19 | | | | | 0 |
| His | His | His | His | His | Pro | Ser | Pro | Pro | Pro | Gly | | Lys | | | | Ser | Gln | Thr | i | 18 | 196 | | | -13 | -19 | | | | | 4 |
| His | His | His | His | His | Pro | Ser | Pro | Pro | Pro | Gly | | Lys | | | | Gly | Gln | Thr | i | 18 | 197 | | | -8 | -15 | | | | | 5 |
| His | His | His | His | His | Pro | Ser | Pro | Pro | Pro | Gly | | Lys | | | | | Gln | Thr | i | 18 | 198 | 2 | -5 | -8 | -20 | | | | | 4 |
| His | His | His | His | His | Pro | Ser | Pro | Pro | Pro | Gly | | Lys | | | | | Thr | Gln | i | 18 | 199 | | | -10 | -18 | | | | | 4 |
| His | His | His | His | His | Pro | Ser | Pro | Pro | Pro | Gly | | Lys | | | | | His | Thr | i | 18 | 200 | -4 | -12 | -9 | -23 | 2 | 3 | | | 4 |
| His | His | His | His | His | Pro | Ser | Pro | Pro | Pro | Gly | | Lys | | | | | Asn | His | i | 16 | 201 | 11 | -9 | 3 | -15 | 8 | 8 | | | 3 |
| His | His | His | His | His | Pro | Ser | Pro | Pro | Pro | Gly | | Lys | | | | | Thr | His | i | 14 | 202 | | | 4 | -10 | | | | | 5 |
| His | His | His | His | His | Pro | Ser | Pro | Pro | Pro | Gly | | Lys | | | | | | His | i | 18 | 203 | -1 | -10 | -19 | -21 | 3 | 4 | | | 4 |
| His | His | His | His | His | Pro | Ser | Pro | Pro | Pro | Gly | | Lys | | | | | | Asn | i | 18 | 204 | 0 | -11 | -8 | -19 | 2 | 2 | | | 3 |
| His | His | His | His | His | Pro | Ser | Pro | Pro | Pro | Gly | | Lys | | | | | | Gln | i | 18 | 205 | -3 | -13 | -2 | -23 | 5 | 6 | | | 5 |
| His | His | His | His | His | Glu | Ser | Pro | Pro | Pro | Gly | | Lys | | | | | Thr | His | i | 18 | 206 | 3 | -10 | | | 1 | 2 | | | 4 |
| His | His | His | His | His | Ala | Ser | Gly | Pro | Pro | Gly | | Lys | | | | Ser | Gly | Thr | i | 18 | 207 | 1 | -15 | | | 7 | 4 | | | 7 |
| His | His | His | His | His | Glu | Ser | Pro | Gly | Pro | Gly | | Lys | | | | Gly | Gly | Ser | i | 18 | 208 | 1 | -12 | | | 3 | 5 | | | 4 |
| His | His | His | His | His | Ala | Ser | Pro | Pro | Pro | Gly | | Lys | | | | Ser | Gly | Thr | i | 18 | 209 | -7 | -19 | | | 5 | 3 | | | 3 |
| His | His | His | His | His | Glu | Ser | Pro | Gly | Pro | Gly | | Lys | | | | Ser | Gly | Thr | i | 14 | 210 | 0 | -9 | | | 8 | 9 | | | 5 |
| His | His | His | His | His | Glu | Ser | Pro | Pro | Pro | Gly | | Lys | | | | Ser | Gly | Thr | i | 18 | 211 | 0 | -14 | | | 7 | 4 | | | 4 |
| His | His | His | His | His | Glu | Ser | Glu | Pro | Pro | Gly | | Lys | | | | Ser | Gly | Thr | i | 18 | 212 | -4 | -17 | | | 7 | 2 | | | 7 |
| His | His | His | His | His | Glu | Ser | Pro | Gly | Pro | Gly | | Lys | | | | Ser | Gly | Thr | i | 18 | 213 | -12 | -17 | | | 4 | 1 | | | 5 |
| His | His | His | His | His | Glu | Ser | Pro | Pro | Pro | Gly | | Lys | | | | Ser | Gly | Thr | i | 18 | 214 | 1 | -19 | | | 6 | 5 | | | 9 |
| His | His | His | His | His | Ser | Ser | Pro | Gly | Pro | Gly | | Lys | | | | Ser | Gly | Thr | i | 18 | 215 | 2 | -13 | | | 5 | 4 | | | |
| His | His | His | His | His | Ser | Gly | Gly | Gly | | | | Lys | | | | | | | i | 16 | 216 | -1 | 0 | | | | | | | |
| His | His | His | His | His | Ser | Gly | Gly | Gly | | | | Lys | | | | Gly | Ser | Gly | iii | 18 | 217 | 1 | 1 | | | | | | | |
| His | His | His | His | His | Ala | Ser | Gly | Ser | | | | Lys | | | | Ser | Gly | Gly | iii | 18 | 218 | -10 | -1 | | | | | | | |
| His | His | His | His | His | Ser | Ser | Gly | Gly | | | | Lys | | | | Gly | Gly | Gly | i | 18 | 219 | -7 | -3 | | | | | | | |
| His | His | His | His | His | Ala | Ser | Gly | Gly | | | | Lys | | | | Ser | Gly | Ser | i | 18 | 220 | 1 | -3 | | | | | | | |
| His | His | His | His | His | Ser | Ser | Gly | Gly | | | | Lys | | | | Ser | Gly | Ser | i | 18 | 221 | 0 | -3 | | | | | | | |
| His | His | His | His | His | Ala | Ser | Gly | Ser | | | | Lys | | | | Ser | Gly | Ser | i | 18 | 222 | 2 | -4 | | | | | | | |
| His | His | His | His | His | Ala | Ser | Gly | Gly | | | | Lys | | | | Ser | Gly | Ser | i | 18 | 223 | -6 | -2 | | | | | | | |
| His | His | His | His | His | Ala | Ser | Gly | Gly | | | | Lys | | | | Ser | Gly | Ser | i | 18 | 224 | 4 | -6 | | | | | | | |
| His | His | His | His | His | Ala | Ser | Gly | Gly | | | | Lys | | | | Gly | Gly | Ser | i | 18 | 225 | 0 | 0 | | | | | | | |
| His | His | His | His | His | Ala | Ser | Gly | Gly | | | | Lys | | | | Gly | Gly | Ser | i | 18 | 226 | -2 | -2 | | | | | | | |
| His | His | His | His | His | Ala | Ser | Gly | Gly | | | | Lys | | | | Gly | Gly | Ser | i | 18 | 227 | -1 | -5 | | | | | | | |
| His | His | His | His | His | Ala | Ser | Gly | Gly | | | | Lys | | | | Gly | Gly | Ser | i | 18 | 228 | -5 | -7 | | | 4 | 4 | | | 4 |
| His | His | His | His | His | Ala | Ser | Gly | Gly | | | | Lys | | | | Thr | His | Thr | i | 18 | 229 | -4 | -3 | | | | | | | |

Figure 1 (Continued)

| Ex | G ref | SEQ ID | Note | 1 | 2 | 3 | 4 | 5 | 6 | 7 | 8 | 9 | 10 | 11 | 12 | 13 | 14 | 15 | 16 | 17 | 18 | 19 | 20 | 21 | 22 | 23 | 24 | 25 | 26 | 27 | 28 | 29 |
|---|---|---|---|---|---|---|---|---|---|---|---|---|---|---|---|---|---|---|---|---|---|---|---|---|---|---|---|---|---|---|---|---|
| 230 | 5413 | 230 | | His | AiB | His | Gly | Thr | Phe | Thr | Ser | Asp | Tyr | Ser | Arg | Tyr | Leu | Asp | Ala | Lys | Arg | Ala | His | Glu | Phe | Ile | Glu | Trp | Leu | Leu | His | Gly |
| 231 | 5414 | 231 | | His | AiB | His | Gly | Thr | Phe | Thr | Ser | Asp | Tyr | Ser | Arg | Tyr | Leu | Asp | Ala | Lys | Arg | Ala | His | Glu | Phe | Ile | Glu | Trp | Leu | Leu | His | Gly |
| 232 | 5415 | 232 | | His | AiB | His | Gly | Thr | Phe | Thr | Ser | Asp | Tyr | Ser | Arg | Tyr | Leu | Asp | Glu | Lys | Arg | Ala | Gln | Glu | Phe | Ile | Glu | Trp | Leu | Leu | Thr | Gly |
| 233 | 5416 | 233 | | His | AiB | His | Gly | Thr | Phe | Thr | Ser | Asp | Tyr | Ser | Arg | Tyr | Leu | Asp | Ala | Lys | Arg | Ala | Gln | Glu | Phe | Ile | Glu | Trp | Leu | Leu | Thr | Gly |
| 234 | 5417 | 234 | | His | AiB | His | Gly | Thr | Phe | Thr | Ser | Asp | Tyr | Ser | Arg | Tyr | Leu | Asp | Ala | Lys | Arg | Ala | Gln | Glu | Phe | Ile | Glu | Trp | Leu | Leu | Thr | Gly |
| 235 | 5418 | 235 | | His | AiB | His | Gly | Thr | Phe | Thr | Ser | Asp | Tyr | Ser | Arg | Tyr | Leu | Asp | Ala | Lys | Arg | Ala | Gln | Glu | Phe | Ile | Glu | Trp | Leu | Leu | Ala | Ser |
| 236 | 5419 | 236 | | His | AiB | His | Gly | Thr | Phe | Thr | Ser | Asp | Tyr | Ser | Arg | Tyr | Leu | Asp | Glu | Lys | Arg | Ala | Gln | Glu | Phe | Ile | Glu | Trp | Leu | Leu | Ala | Ser |
| 237 | 5420 | 237 | | His | AiB | His | Gly | Thr | Phe | Thr | Ser | Asp | Tyr | Ser | Arg | Tyr | Leu | Asp | Ala | Lys | Arg | Ala | Gln | Glu | Phe | Ile | Glu | Trp | Leu | Leu | Ala | Ser |
| 238 | 5421 | 238 | | His | AiB | His | Gly | Thr | Phe | Thr | Ser | Asp | Tyr | Ser | Arg | Tyr | Leu | Asp | Ala | Lys | Arg | Ala | Gln | Glu | Phe | Ile | Glu | Trp | Leu | Leu | Ala | Ser |
| 239 | 5422 | 239 | | His | AiB | His | Gly | Thr | Phe | Thr | Ser | Asp | Tyr | Ser | Arg | Tyr | Leu | Asp | Glu | Lys | Arg | Ala | His | Glu | Phe | Ile | Glu | Trp | Leu | Leu | His | Gly |
| 240 | 5423 | 240 | | His | AiB | His | Gly | Thr | Phe | Thr | Ser | Asp | Tyr | Ser | Arg | Tyr | Leu | Asp | Ala | Arg | Arg | Ala | His | Glu | Phe | Ile | Glu | Trp | Leu | Leu | His | Gly |
| 241 | 5424 | 241 | | His | AiB | His | Gly | Thr | Phe | Thr | Ser | Asp | Tyr | Ser | Arg | Tyr | Leu | Asp | Glu | Arg | Arg | Ala | His | Glu | Phe | Ile | Glu | Trp | Leu | Leu | His | Gly |
| 242 | 5425 | 242 | | His | AiB | His | Gly | Thr | Phe | Thr | Ser | Asp | Tyr | Ser | Arg | Tyr | Leu | Asp | Ala | Lys | Arg | Ala | His | Glu | Phe | Ile | Glu | Trp | Leu | Leu | His | Ser |
| 243 | 5426 | 243 | | His | AiB | His | Gly | Thr | Phe | Thr | Ser | Asp | Tyr | Ser | Arg | Tyr | Leu | Asp | Glu | Lys | Arg | Ala | His | Glu | Phe | Ile | Glu | Trp | Leu | Leu | His | Ser |
| 244 | 5427 | 244 | | His | AiB | His | Gly | Thr | Phe | Thr | Ser | Asp | Tyr | Ser | Arg | Tyr | Leu | Asp | Ala | Lys | Arg | Ala | His | Glu | Phe | Ile | Glu | Trp | Leu | Leu | Asn | Ser |
| 245 | 5428 | 245 | | His | AiB | His | Gly | Thr | Phe | Thr | Ser | Asp | Tyr | Ser | Arg | Tyr | Leu | Asp | Ala | Lys | Arg | Ala | His | Glu | Phe | Ile | Glu | Trp | Leu | Leu | Asn | Ser |
| 246 | 5429 | 246 | Dup Ex 50 | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 247 | 5430 | 247 | Dup Ex 74 | His | AiB | His | Gly | Thr | Phe | Thr | Ser | Asp | Tyr | Ser | Lys | Tyr | Leu | Asp | Glu | Arg | Arg | Ala | Gln | Glu | Phe | Ile | Glu | Trp | Leu | Leu | Ala | Ser |
| 248 | 5433 | 248 | | His | AiB | His | Gly | Thr | Phe | Thr | Ser | Asp | Tyr | Ser | Lys | Tyr | Leu | Asp | Ala | Arg | Arg | Ala | Gln | Glu | Phe | Ile | Glu | Trp | Leu | Leu | Ala | Ser |
| 249 | 5434 | 249 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 250 | 5435 | 250 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 251 | 5436 | 251 | | His | AiB | His | Gly | Thr | Phe | Thr | Ser | Asp | Tyr | Ser | Lys | Tyr | Leu | Asp | Gln | Lys | Arg | Ala | Gln | Glu | Phe | Ile | Glu | Trp | Leu | Leu | Gln | Gly |
| 252 | 5437 | 252 | | His | AiB | His | Gly | Thr | Phe | Thr | Ser | Asp | Tyr | Ser | Lys | Tyr | Leu | Asp | Glu | Lys | Arg | Ala | Gln | Glu | Phe | Ile | Glu | Trp | Leu | Leu | His | Ser |
| 253 | 5438 | 253 | | His | AiB | His | Gly | Thr | Phe | Thr | Ser | Asp | Tyr | Ser | Lys | Tyr | Leu | Asp | Ala | Lys | Arg | Ala | His | Glu | Phe | Ile | Glu | Trp | Leu | Leu | Asn | Ser |
| 254 | 5439 | 254 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Ala | Thr |
| 255 | 5440 | 255 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 256 | 5441 | 256 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Ala | Ser |
| 257 | 5442 | 257 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 258 | 5443 | 258 | | His | AiB | His | Gly | Thr | Phe | Thr | Ser | Asp | Tyr | Ser | Lys | Tyr | Leu | Asp | Gln | Lys | Arg | Ala | Gln | Glu | Phe | Ile | Glu | Trp | Leu | Leu | His | Ser |
| 259 | 5445 | 259 | | His | AiB | His | Gly | Thr | Phe | Thr | Ser | Asp | Tyr | Ser | Lys | Tyr | Leu | Asp | Gly | Lys | Arg | Ala | Gln | Glu | Phe | Ile | Glu | Trp | Leu | Leu | Ala | Gly |
| 260 | 5446 | 260 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Asn | Ser |
| 261 | 5447 | 261 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 262 | 5449 | 262 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 263 | 5450 | 263 | | His | AiB | His | Gly | Thr | Phe | Thr | Ser | Asp | Tyr | Ser | Lys | Tyr | Leu | Asp | Ala | Lys | Arg | Ala | His | Glu | Phe | Ile | Glu | Trp | Leu | Leu | Ala | Ser |
| 264 | 5451 | 264 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 265 | 5452 | 265 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Asn | Ser |
| 266 | 5453 | 266 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 267 | 5454 | 267 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |

Figure 1 (Continued)

| 30 | 31 | 32 | 33 | 34 | 35 | 36 | 37 | 38 | 39 | 40 | 41 | 42 | 43 | 44 | 45 | 46 | 47 | 48 | Z | n (R=Cn) | Ex | 7.5nM single intake | loss | 15nM single intake | loss | 30nM single intake | loss | rpt dose intake | loss | Ratio Gluc/GLP-1 |
|---|---|---|---|---|---|---|---|---|---|---|---|---|---|---|---|---|---|---|---|---|---|---|---|---|---|---|---|---|---|---|
| His | His | His | His | His | Ala | Ser | Gly |  |  |  |  |  |  |  |  |  | Thr | His | i | 18 | 230 | -4 | -7 |  |  |  |  |  |  |  |
| His | His | His | His | His | Ala | Ser | Gly |  |  |  |  | Lys |  |  |  | Thr | His | Thr | i | 18 | 231 | -2 | 2 |  |  |  |  |  |  |  |
| His | His | His | His | His | Ala | Ser | Gly | Ser |  |  |  | Lys |  |  | Gly | Gly | Ser | Gly | i | 18 | 232 | 11 | 0 |  |  |  |  |  |  |  |
| His | His | His | His | His | Ala | Ser | Gly | Ser |  |  |  | Lys |  |  | Gly | Gly | Ser | Gly | i | 18 | 233 | -11 | -3 |  |  |  |  | 2 | 1 |  |
| His | His | His | His | His | Ala | Ser | Gly | Ser |  |  |  | Lys |  |  |  |  | Thr | His | i | 18 | 234 | -4 | -10 |  |  |  |  |  |  |  |
| His | His | His | His | His | Pro | Ser | Pro | Pro | Pro | Ser | Gly | Lys |  |  |  |  | Thr | His | i | 18 | 235 | -7 | -11 |  |  |  |  | 3 | 1 | 4 |
| His | His | His | His | His | Pro | Ser | Pro | Pro | Pro | Ser | Gly | Lys |  |  |  |  | Thr | His | i | 18 | 236 | -4 | -9 |  |  |  |  | 3 | 3 | 3 |
| His | His | His | His | His | Pro | Ser | Pro | Pro | Pro | Ser | Gly | Lys |  |  | Gly | Ser | Gly | Ser | i | 18 | 237 | -3 | -16 |  |  |  |  |  |  |  |
| His | His | His | His | His | Pro | Ser | Pro | Pro | Pro | Ser | Gly | Lys |  |  | Gly | Ser | Gly | Ser | i | 18 | 238 | 2 | -15 |  |  |  |  |  |  |  |
| His | His | His | His | His | Pro | Ser | Pro | Pro | Pro | Ser | Gly | Lys |  |  |  |  |  |  | i | 18 | 239 | -8 | -4 |  |  |  |  |  |  |  |
| His | His | His | His | His | Pro | Ser | Pro | Pro | Pro | Ser | Gly | Lys |  |  |  |  | Thr | His | i | 18 | 240 | -4 | -8 |  |  |  |  |  |  |  |
| His | His | His | His | His | Pro | Ser | Pro | Pro | Pro | Ser | Gly | Lys |  |  | Gly | Ser | Gly | Ser | i | 18 | 241 | -14 | -15 |  |  |  |  | 2 | 2 | 3 |
| His | His | His | His | His | Pro | Ser | Pro | Pro | Pro | Ser | Gly | Lys |  |  |  |  | Thr | His | i | 18 | 242 | -6 | -16 |  |  |  |  | 5 | 5 | 4 |
| His | His | His | His | His | Pro | Ser | Pro | Pro | Pro | Gly |  | Lys |  |  |  |  |  |  | i | 18 | 243 | -11 | -16 |  |  |  |  |  |  |  |
| His | His | His | His | His | Pro | Ser | Pro | Pro | Pro | Ser |  | Lys |  |  | Thr | Gly | Ser | Gly | i | 18 | 244 | -6 | -3 |  |  |  |  |  |  |  |
| His | His | His | His | His | Pro | Ser | Pro | Pro | Pro | Ser |  | Lys |  |  | Thr | Gly | Ser | Gly | i | 16 | 245 | -2 | -4 |  |  |  |  |  |  |  |
| His | His | His | His | His | Ser | Ser | Pro | Pro |  | Ser | Gly | Lys |  |  | Gly | Ser | Gly | Ser | i | 18 | 246 |  |  |  |  |  |  |  |  |  |
| His | His | His | His | His | Pro | Ser | Pro | Gly | Pro | Pro |  | Lys |  |  |  |  |  |  | i | 18 | 247 |  |  |  |  |  |  |  |  |  |
| His | His | His | His | His | Glu | Ser | Glu | Pro | Pro | Gly |  | Lys |  |  | Gly | Ser | Gly | Thr | i | 18 | 248 | -13 | -16 |  |  |  |  | 4 | 2 | 6 |
| His | His | His | His | His | Pro | Ser | Pro | Gly | Pro | Gly |  | Lys |  |  | Gly | Ser | Gly | Ser | i | 18 | 249 | -5 | -11 |  |  |  |  | 4 | 5 | 5 |
| His | His | His | His | His | Glu | Ser | Glu | Gly | Pro |  |  | Lys |  |  | Gly | Ser | Gly | Ser | i | 18 | 250 | -15 | -9 |  |  |  |  |  |  |  |
| His | His | His | His | His | Pro | Ser | Glu | Gly |  |  |  | Lys |  |  | Gly | Ser | Gly | Ser | i | 18 | 251 | -3 | -7 |  |  |  |  |  |  |  |
| His | His | His | His | His | Ser | Ser | Glu | Gly | Pro | Pro |  | Lys |  |  | Gly | Ser | Gly | Ser | i | 18 | 252 | 5 | -9 |  |  |  |  | 4 | 3 | 5 |
| His | His | His | His | His | Pro | Ser | Pro | Gly | Pro | Gly |  | Lys |  |  | Gly | Ser | Gly | Ser | i | 18 | 253 | -1 | -10 |  |  |  |  | 5 | 2 | 5 |
| His | His | His | His | His | Glu | Ser | Glu | Gly | Pro | Gly |  | Lys |  |  | Thr | Ser | Gly | Ser | i | 18 | 254 | 8 | -3 |  |  |  |  |  |  | 3 |
| His | His | His | His | His | Pro | Ser | Pro | Gly | Pro | Gly |  | Lys |  |  | Gly | Ser | Thr | Thr | i | 20 | 255 |  |  |  |  |  |  | 10 | 6 | 6 |
| His | His | His | His | His | Glu | Ser | Glu | Gly | Pro | Gly |  | Lys |  |  |  | Ser | Gly | Ser | i | 20 | 256 | 0 | -4 |  |  |  |  | 5 | 2 |  |
| His | His | His | His | His | Pro | Ser | Pro | Gly | Pro | Gly |  | Lys |  |  |  | Ser | Gly | Ser | i | 20 | 257 | 0 | -5 |  |  |  |  | 4 | 5 |  |
| His | His | His | His | His | Glu | Ser | Glu | Gly | Pro | Gly |  | Lys |  |  |  | Ser | Gly | Ser | i | 20 | 258 | 0 | -11 |  |  |  |  | 1 | 1 |  |
| His | His | His | His | His | Pro | Ser | Pro | Gly | Pro | Gly |  | Lys |  |  | Gly | Ser | Ser | Gly | i | 20 | 259 | 5 | -7 |  |  |  |  | 2 | 1 |  |
| His | Gln | His | His | His | Glu | Ser | Glu | Gly | Pro | Gly |  | Lys |  |  | Thr | Gly | Gly | Thr | i | 22 | 260 | 0 | -7 |  |  |  |  |  |  |  |
| His | Gln | His | His | His | Pro |  | Pro | Gly | Pro | Gly |  | Lys |  |  |  | Ser | Gly | Asn | i | 22 | 261 | 0 | -9 |  |  |  |  |  |  |  |
| His | His | His | His | His | Glu |  | Glu | Gly | Pro | Gly |  | Lys |  |  |  |  |  | Gln | i | 18 | 262 | 4 | -11 |  |  |  |  | 7 | 7 | 5 |
| His | His | His | His | His | Pro | Ser | Pro | Pro | Pro | Gly |  | Lys |  |  |  |  |  | Asn | i | 18 | 263 | 0 | -7 |  |  |  |  | 9 | 8 | 7 |
| His | His | His | His | His | Glu | Ser | Glu | Gly | Pro | Gly |  | Lys |  |  |  |  |  | Gln | i | 20 | 264 | 4 | -9 |  |  |  |  |  |  |  |
| His | His | His | His | His | Pro | Ser | Pro | Pro | Pro | Gly |  | Lys |  |  |  |  |  | Gln | i | 20 | 265 | -2 | -15 |  |  |  |  |  |  | 6 |
| His | His | His | His | His | Pro | Ser | Pro | Pro | Pro |  |  | Lys |  |  |  |  |  | Gln | i | 18 | 266 | -2 | -6 |  |  |  |  | 7 | 7 |  |
| His | His | His | His | His | Pro | Ser | Pro | Pro | Pro |  |  | Lys |  |  |  |  |  | Gln | i | 18 | 267 |  |  |  |  |  |  |  |  |  |

Figure 1 (Continued)

| Ex | G ref | SEQ ID | Note | 1 | 2 | 3 | 4 | 5 | 6 | 7 | 8 | 9 | 10 | 11 | 12 | 13 | 14 | 15 | 16 | 17 | 18 | 19 | 20 | 21 | 22 | 23 | 24 | 25 | 26 | 27 | 28 | 29 |
|---|---|---|---|---|---|---|---|---|---|---|---|---|---|---|---|---|---|---|---|---|---|---|---|---|---|---|---|---|---|---|---|---|
| 268 | 5455 | 268 | | His | AIB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 269 | 5456 | 269 | Ex205 Ac | His | AIB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 270 | 5457 | 270 | | His | AIB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 271 | 5458 | 271 | | His | AIB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 272 | 5459 | 272 | | His | AIB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 273 | 5460 | 273 | Dup Ex167 | His | AIB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 274 | 5461 | 274 | Dup Ex137 | His | AIB | His | Gly | Thr | Phe | Thr | Ser | Asp | Tyr | Ser | Arg | Tyr | Leu | Asp | Glu | Arg | Arg | Ala | Gln | Glu | Phe | Ile | Glu | Trp | Leu | Leu | Gln | Gly |
| 275 | 5465 | 275 | | His | AIB | His | Gly | Thr | Phe | Thr | Ser | Asp | Tyr | Ser | Arg | Tyr | Leu | Asp | Ala | Lys | Arg | Ala | Gln | Glu | Phe | Ile | Glu | Trp | Leu | Leu | Gln | Ser |
| 276 | 5466 | 276 | | His | AIB | His | Gly | Thr | Phe | Thr | Ser | Asp | Tyr | Ser | Arg | Tyr | Leu | Asp | Ala | Lys | Arg | Ala | Gln | Glu | Phe | Ile | Glu | Trp | Leu | Leu | Gln | Ser |
| 277 | 5467 | 277 | | His | AIB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 278 | 5468 | 278 | | His | AIB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 279 | 5469 | 279 | | His | AIB | His | Gly | Thr | Phe | Thr | Ser | Asp | Tyr | Ser | Arg | Tyr | Leu | Asp | Ala | Lys | Arg | Ala | Gln | Glu | Phe | Ile | Glu | Trp | Leu | Leu | Gln | Ser |
| 280 | 5470 | 280 | | His | AIB | His | Gly | Thr | Phe | Thr | Ser | Asp | Tyr | Ser | Arg | Tyr | Leu | Asp | Ala | Lys | Arg | Ala | Gln | Glu | Phe | Ile | Glu | Trp | Leu | Leu | Gln | Ser |
| 281 | 5471 | 281 | Ex159 Ac | His | AIB | His | Gly | Thr | Phe | Thr | Ser | Asp | Tyr | Ser | Arg | Tyr | Leu | Asp | Ala | Lys | Arg | Ala | Gln | Glu | Phe | Ile | Glu | Trp | Leu | Leu | Gln | Ser |
| 282 | 5472 | 282 | | His | AIB | His | Gly | Thr | Phe | Thr | Ser | Asp | Tyr | Ser | Arg | Tyr | Leu | Asp | Ala | Arg | Arg | Ala | Gln | Glu | Phe | Ile | Glu | Trp | Leu | Leu | Gln | Ser |
| 283 | 5473 | 283 | | His | AIB | His | Gly | Thr | Phe | Thr | Ser | Asp | Tyr | Ser | Arg | Tyr | Leu | Asp | Ala | Arg | Arg | Ala | Gln | Glu | Phe | Ile | Glu | Trp | Leu | Leu | Gln | Ser |
| 284 | 5474 | 284 | | His | AIB | His | Gly | Thr | Phe | Thr | Ser | Asp | Tyr | Ser | Arg | Tyr | Leu | Asp | Ala | Arg | Arg | Ala | Gln | Glu | Phe | Ile | Glu | Trp | Leu | Leu | Gln | Ser |
| 285 | 5475 | 285 | | His | AIB | His | Gly | Thr | Phe | Thr | Ser | Asp | Tyr | Ser | Arg | Tyr | Leu | Asp | Ala | Arg | Arg | Ala | Gln | Glu | Phe | Ile | Glu | Trp | Leu | Leu | Gln | Ser |
| 286 | 5476 | 286 | | His | AIB | His | Gly | Thr | Phe | Thr | Ser | Asp | Tyr | Ser | Arg | Tyr | Leu | Asp | Ala | Arg | Arg | Ala | Gln | Glu | Phe | Ile | Glu | Trp | Leu | Leu | Gln | Ser |
| 287 | 5477 | 287 | | His | AIB | His | Gly | Thr | Phe | Thr | Ser | Asp | Tyr | Ser | Arg | Tyr | Leu | Asp | Ala | Arg | Arg | Ala | Gln | Glu | Phe | Ile | Glu | Trp | Leu | Leu | Gln | Ser |
| 288 | 5478 | 288 | | His | AIB | His | Gly | Thr | Phe | Thr | Ser | Asp | Tyr | Ser | Arg | Tyr | Leu | Asp | Ala | Lys | Arg | Ala | Gln | Glu | Phe | Ile | Glu | Trp | Leu | Leu | Gln | Ser |
| 289 | 5479 | 289 | | His | AIB | His | Gly | Thr | Phe | Thr | Ser | Asp | Tyr | Ser | Lys | Tyr | Leu | Asp | Ala | Arg | Arg | Ala | Gln | Glu | Phe | Ile | Glu | Trp | Leu | Leu | Gln | Ser |
| 290 | 5480 | 290 | | His | AIB | His | Gly | Thr | Phe | Thr | Ser | Asp | Tyr | Ser | Lys | Tyr | Leu | Asp | Ala | Arg | Arg | Ala | Gln | Glu | Phe | Ile | Glu | Trp | Leu | Leu | Gln | Ser |
| 291 | 5481 | 291 | | His | AIB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 292 | 5482 | 292 | | His | AIB | His | Gly | Thr | Phe | Thr | Ser | Asp | Tyr | Ser | Arg | Tyr | Leu | Asp | Ala | Arg | Arg | Ala | Gln | Glu | Phe | Ile | Glu | Trp | Leu | Leu | Gln | Ser |
| 293 | 5483 | 293 | | His | AIB | His | Gly | Thr | Phe | Thr | Ser | Asp | Tyr | Ser | Arg | Tyr | Leu | Asp | Glu | Arg | Arg | Ala | Gln | Glu | Phe | Ile | Glu | Trp | Leu | Leu | Gln | Gly |
| 294 | 5484 | 294 | | His | AIB | His | Gly | Thr | Phe | Thr | Ser | Asp | Tyr | Ser | Arg | Tyr | Leu | Asp | Glu | Arg | Arg | Ala | Gln | Glu | Phe | Ile | Glu | Trp | Leu | Leu | Gln | Gly |
| 295 | 5485 | 295 | | His | AIB | His | Gly | Thr | Phe | Thr | Ser | Asp | Tyr | Ser | Arg | Tyr | Leu | Asp | Ala | Arg | Arg | Ala | Gln | Glu | Phe | Ile | Glu | Trp | Leu | Leu | Asn | Gly |
| 296 | 5486 | 296 | | His | AIB | His | Gly | Thr | Phe | Thr | Ser | Asp | Tyr | Ser | Arg | Tyr | Leu | Asp | Ala | Arg | Arg | Ala | His | Glu | Phe | Ile | Glu | Trp | Leu | Leu | Asn | Gly |
| 297 | 5487 | 297 | | His | AIB | His | Gly | Thr | Phe | Thr | Ser | Asp | Tyr | Ser | Lys | Tyr | Leu | Asp | Ala | Arg | Arg | Ala | His | Glu | Phe | Ile | Glu | Trp | Leu | Leu | Asn | Gly |
| 298 | 5488 | 298 | | His | AIB | His | Gly | Thr | Phe | Thr | Ser | Asp | Tyr | Ser | Lys | Tyr | Leu | Asp | Ala | Arg | Arg | Ala | His | Glu | Phe | Ile | Glu | Trp | Leu | Leu | His | Gly |
| 299 | 5489 | 299 | | His | AIB | His | Gly | Thr | Phe | Thr | Ser | Asp | Tyr | Ser | Lys | Tyr | Leu | Asp | Ala | Lys | Arg | Ala | His | Glu | Phe | Ile | Glu | Trp | Leu | Leu | His | Gly |
| 300 | 5490 | 300 | | His | AIB | His | Gly | Thr | Phe | Thr | Ser | Asp | Tyr | Ser | Arg | Tyr | Leu | Asp | Ala | Arg | Arg | Ala | Gln | Glu | Phe | Ile | Glu | Trp | Leu | Leu | His | Gly |
| 301 | 5491 | 301 | Ex201 Ac | His | AIB | His | Gly | Thr | Phe | Thr | Ser | Asp | Tyr | Ser | Lys | Tyr | Leu | Asp | Ala | Arg | Arg | Ala | Gln | Glu | Phe | Ile | Glu | Trp | Leu | Leu | Gln | Ser |
| 302 | 5492 | 302 | Ex107 Ac | His | AIB | His | Gly | Thr | Phe | Thr | Ser | Asp | Tyr | Ser | Lys | Tyr | Leu | Asp | Ala | Arg | Arg | Ala | Gln | Glu | Phe | Ile | Glu | Trp | Leu | Leu | Gln | Ser |
| 303 | 5493 | 303 | | His | AIB | His | Gly | Thr | Phe | Thr | Ser | Asp | Tyr | Ser | Arg | Tyr | Leu | Asp | Ala | Arg | Arg | Ala | Gln | Glu | Phe | Ile | Glu | Trp | Leu | Leu | Ala | Ser |
| 304 | 5494 | 304 | | His | AIB | His | Gly | Thr | Phe | Thr | Ser | Asp | Tyr | Arg | Arg | Tyr | Leu | Asp | Ala | Arg | Arg | Ala | Gln | Glu | Phe | Ile | Glu | Trp | Leu | Leu | His | Gly |

Figure 1 (Continued)

| 30 | 31 | 32 | 33 | 34 | 35 | 36 | 37 | 38 | 39 | 40 | 41 | 42 | 43 | 44 | 45 | 46 | 47 | 48 | Z | n (R=C$_n$) | Ex | 7.5nM single intake | loss | 15nM single intake | loss | 30nM single intake | loss | rpt dose intake | loss | Ratio Gluc/GLP-1 |
|---|---|---|---|---|---|---|---|---|---|---|---|---|---|---|---|---|---|---|---|---|---|---|---|---|---|---|---|---|---|---|
| His | His | His | His | His | Pro | Ser | Pro | Pro | Gly | | | Lys | | | | | | Gln | i | 18 | 268 | 1 | -8 | | | | | 5 | 6 | |
| His | His | His | His | His | Pro | Ser | Pro | Pro | Pro | Gly | | Lys | | | | | | Gln | i | 18 | 269 | -6 | -4 | | | | | | | |
| His | His | His | His | His | Pro | Ser | Pro | Pro | Pro | Gly | | Lys | | | | | Gln | Gly | i | 18 | 270 | 3 | -4 | | | | | | | |
| His | His | His | His | His | Pro | Ser | Pro | Pro | Pro | Gly | | Lys | | | | | Gly | Gln | i | 18 | 271 | 2 | -2 | | | | | | | |
| His | His | His | His | His | Pro | Ser | Pro | Pro | Pro | Gly | | Lys | | | | | Gly | Gln | i | 22 | 272 | 4 | -2 | | | | | | | |
| His | His | His | His | His | Glu | Ser | Pro | Pro | Pro | Gly | | Lys | | | | Ser | Gly | Thr | i | 18 | 273 | 8 | -4 | | | | | | | |
| His | His | His | His | His | Pro | Ser | Pro | Pro | Pro | Gly | | Lys | | | | Thr | His | Thr | i | 18 | 274 | | | | | | | | | |
| His | His | His | His | His | Glu | Ser | Pro | Pro | Pro | Gly | | Lys | | | | Ser | Gly | Thr | i | 16 | 275 | -5 | -3 | | | | | | | 9 |
| His | His | His | His | His | Glu | Ser | Pro | Pro | Pro | Gly | | Lys | | | | | | Gln | i | 18 | 276 | -1 | -7 | | | | | | | 5 |
| His | His | His | His | His | Pro | Ser | Pro | Pro | Pro | Gly | | Lys | | | | Ser | Gly | Thr | i | 18 | 277 | -2 | -5 | | | | | | | |
| His | His | Gln | His | His | Pro | Ser | Pro | Pro | Pro | Gly | | Lys | | | | | | Gln | i | 16 | 278 | -7 | -10 | | | | | 11 | 8 | |
| His | His | His | His | His | Pro | Ser | Pro | Pro | Gly | | | Lys | | | | | | Gln | i | 18 | 279 | 17 | -1 | | | | | | | |
| His | His | His | His | His | Pro | Ser | Pro | Pro | Pro | Gly | | Lys | | | | Ser | Gly | Thr | i | 18 | 280 | 8 | -5 | | | | | | | |
| His | His | His | His | His | Pro | Ser | Pro | Pro | Pro | Gly | | Lys | | | | Ser | Gly | Thr | i | 18 | 281 | | | | | | | 7 | 8 | 1 |
| His | His | His | His | His | Pro | Ser | Pro | Pro | Pro | Gly | | Lys | | | | | Gly | Ser | i | 16 | 282 | | | | | | | 6 | 4 | 4 |
| His | His | His | His | His | Pro | Ser | Pro | Pro | Pro | Gly | | Lys | | | | | Gly | Ser | i | 16 | 283 | | | | | | | 5 | 5 | 3 |
| His | His | His | His | His | Pro | Ser | Pro | Pro | Pro | Gly | | Lys | | | | | Asn | His | i | 14 | 284 | | | | | | | 3 | 3 | |
| His | His | His | His | His | Pro | Ser | Pro | Pro | Pro | Gly | | Lys | | | | | Asn | His | i | 18 | 285 | | | | | | | 3 | 0 | |
| His | His | His | His | His | Pro | Ser | Pro | Pro | Pro | Gly | | Lys | | | | | Asn | His | i | 20 | 286 | | | | | | | 0 | 3 | |
| His | His | His | His | His | Pro | Ser | Pro | Pro | Pro | Gly | | Lys | | | | Ser | Gly | Thr | i | 18 | 287 | | | | | | | 4 | 3 | 5 |
| His | His | His | His | His | Pro | Ser | Pro | Pro | Pro | Gly | | Lys | | | | Ser | Gly | Thr | i | 16 | 288 | | | | | | | 4 | 3 | 4 |
| His | His | His | His | His | Pro | Ser | Pro | Pro | Pro | Gly | | Lys | | | | Ser | Gly | Ser | i | 16 | 289 | | | | | | | 10 | 10 | 5 |
| His | His | His | His | His | Pro | Ser | Pro | Pro | Pro | Gly | | Lys | | | | | Gly | Gly | i | 16 | 290 | | | | | | | 10 | 10 | |
| His | His | His | His | His | Pro | Ser | Pro | Pro | Pro | Gly | | Lys | | | Thr | Ser | Ser | Gly | i | 16 | 291 | | | | | | | 8 | 8 | 4 |
| His | His | His | His | His | Glu | Ser | Pro | Pro | Pro | Gly | | Lys | | | Thr | Ser | Ser | Gly | i | 18 | 292 | | | | | | | 2 | 0 | |
| His | His | His | His | His | Glu | Ser | Pro | Pro | Pro | Gly | | Lys | | | Thr | Ser | Ser | Gly | i | 18 | 293 | | | | | | | 2 | 3 | |
| His | His | His | His | His | Pro | Ser | Pro | Pro | Pro | Gly | | Lys | | | | | Gly | Ser | i | 16 | 294 | | | | | | | 7 | 5 | |
| His | His | His | His | His | Pro | Ser | Pro | Pro | Pro | Gly | | Lys | | | | Ser | Gly | Ser | i | 18 | 295 | | | | | | | 3 | 0 | 4 |
| His | His | His | His | His | Glu | Ser | Pro | Pro | Pro | Gly | | Lys | | | | Ser | Gly | Ser | i | 18 | 296 | | | | | | | 4 | 1 | |
| His | His | His | His | His | Glu | Ser | Pro | Pro | Pro | Gly | | Lys | | | | Ser | Gly | His | i | 18 | 297 | | | | | | | 5 | 2 | |
| His | His | His | His | His | Pro | Ser | Pro | Pro | Pro | Gly | | Lys | | | | | Gly | His | i | 16 | 298 | | | | | | | 8 | 4 | |
| His | His | His | His | His | Glu | Ser | Pro | Pro | Pro | Gly | | Lys | | | | | Gly | His | i | 16 | 299 | | | | | | | 8 | 8 | 5 |
| His | His | His | His | His | Pro | Ser | Pro | Pro | Pro | Gly | | Lys | | | | | Gly | Gln | i | 18 | 300 | | | | | | | 1 | 1 | 0 |
| His | His | His | His | His | Pro | Ser | Pro | Pro | Pro | Gly | | Lys | | | | | Asn | His | i | 16 | 301 | | | | | | | | | 0 |
| His | His | His | His | His | Glu | Ser | Pro | Pro | Pro | Gly | | Lys | | | | | Gly | Ser | i | 16 | 302 | | | | | | | 3 | 5 | 0 |
| His | His | His | His | His | Pro | Ser | Pro | Pro | Pro | Gly | | Lys | | | | | Asn | His | i | 16 | 303 | | | | | | | 5 | 2 | 0 |
| His | His | His | His | His | Glu | Ser | Pro | Pro | Pro | Gly | | Lys | | | | | Asn | His | i | 16 | 304 | | | | | | | | | 0 |

Figure 1 (Continued)

| Ex | G ref | SEQ ID | Note | 1 | 2 | 3 | 4 | 5 | 6 | 7 | 8 | 9 | 10 | 11 | 12 | 13 | 14 | 15 | 16 | 17 | 18 | 19 | 20 | 21 | 22 | 23 | 24 | 25 | 26 | 27 | 28 | 29 |
|---|---|---|---|---|---|---|---|---|---|---|---|---|---|---|---|---|---|---|---|---|---|---|---|---|---|---|---|---|---|---|---|---|
| 305 | 5495 | 305 | | His | AiB | His | Gly | Thr | Phe | Thr | Ser | Asp | Tyr | Ser | Arg | Tyr | Leu | Asp | Ala | Arg | Arg | Ala | Gln | Glu | Phe | Ile | Glu | Trp | Leu | Leu | Gln | Ser |
| 306 | 5496 | 306 | Ex201 Cl | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 307 | 5497 | 307 | Ex107 Cl | His | AiB | His | Gly | Thr | Phe | Thr | Ser | Asp | Tyr | Ser | Arg | Tyr | Leu | Asp | Ala | Lys | Arg | Ala | Gln | Glu | Phe | Ile | Glu | Trp | Leu | Leu | Gln | Ser |
| 308 | 5498 | 308 | Ex205 Cl | His | AiB | His | Gly | Thr | Phe | Thr | Ser | Asp | Tyr | Ser | Lys | Tyr | Leu | Asp | Ala | Arg | Arg | Ala | Gln | Glu | Phe | Ile | Glu | Trp | Leu | Leu | Gln | Ser |
| 309 | 5499 | 309 | | His | AiB | His | Gly | Thr | Phe | Thr | Ser | Asp | Tyr | Ser | Arg | Tyr | Leu | Asp | Gln | Arg | Arg | Ala | Gln | Glu | Phe | Ile | Glu | Trp | Leu | Leu | Ala | Thr |
| 310 | 5500 | 310 | | His | AiB | His | Gly | Thr | Phe | Thr | Ser | Asp | Tyr | Ser | Lys | Tyr | Leu | Asp | Gln | Lys | Arg | Ala | Gln | Glu | Phe | Ile | Glu | Trp | Leu | Leu | Ala | Thr |
| 311 | 5501 | 311 | | His | AiB | His | Gly | Thr | Phe | Thr | Ser | Asp | Tyr | Ser | Arg | Tyr | Leu | Asp | Gln | Lys | Arg | Ala | Gln | Glu | Phe | Ile | Glu | Trp | Leu | Leu | Ala | Thr |
| 312 | 5502 | 312 | | His | AiB | His | Gly | Thr | Phe | Thr | Ser | Asp | Tyr | Ser | Lys | Tyr | Leu | Asp | Gln | Arg | Arg | Ala | Gln | Glu | Phe | Ile | Glu | Trp | Leu | Leu | Ala | Thr |
| 313 | 5503 | 313 | | His | AiB | His | Gly | Thr | Phe | Thr | Ser | Asp | Tyr | Ser | Arg | Tyr | Leu | Asp | Ala | Arg | Arg | Ala | Gln | Glu | Phe | Ile | Glu | Trp | Leu | Leu | Gln | Ser |
| 314 | 5504 | 314 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 315 | 5505 | 315 | | His | AiB | His | Gly | Thr | Phe | Thr | Ser | Asp | Tyr | Ser | Arg | Tyr | Leu | Asp | Ala | Lys | Arg | Ala | Gln | Glu | Phe | Ile | Glu | Trp | Leu | Leu | Gln | Ser |
| 316 | 5506 | 316 | | His | AiB | His | Gly | Thr | Phe | Thr | Ser | Asp | Tyr | Ser | Lys | Tyr | Leu | Asp | Ala | Arg | Arg | Ala | Gln | Glu | Phe | Ile | Glu | Trp | Leu | Leu | Gln | Ser |
| 317 | 5509 | 317 | | His | AiB | His | Gly | Thr | Phe | Thr | Ser | Asp | Tyr | Ser | Arg | Tyr | Leu | Asp | Ala | Arg | Arg | Ala | Gln | Glu | Phe | Ile | Glu | Trp | Leu | Leu | Gln | Ser |
| 318 | 5510 | 318 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 319 | 5511 | 319 | | His | AiB | His | Gly | Thr | Phe | Thr | Ser | Asp | Tyr | Ser | Lys | Tyr | Leu | Asp | Ala | Arg | Arg | Ala | Gln | Glu | Phe | Ile | Glu | Trp | Leu | Leu | Gln | Ser |
| 320 | 5512 | 320 | | His | AiB | His | Gly | Thr | Phe | Thr | Ser | Asp | Tyr | Ser | Arg | Tyr | Leu | Asp | Ala | Arg | Arg | Ala | Gln | Glu | Phe | Ile | Glu | Trp | Leu | Leu | Gln | Ser |
| 321 | 5513 | 321 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 322 | 5514 | 322 | | His | AiB | His | Gly | Thr | Phe | Thr | Ser | Asp | Tyr | Ser | Arg | Tyr | Leu | Asp | Ala | Arg | Arg | Ala | Gln | Glu | Phe | Ile | Glu | Trp | Leu | Leu | Gln | Ser |
| 323 | 5515 | 323 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 324 | 5516 | 324 | | His | AiB | His | Gly | Thr | Phe | Thr | Ser | Asp | Tyr | Ser | Arg | Tyr | Leu | Asp | Ala | Arg | Arg | Ala | Gln | Glu | Phe | Ile | Glu | Trp | Leu | Leu | Gln | Ser |
| 325 | 5517 | 325 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 326 | 5518 | 326 | | His | AiB | His | Gly | Thr | Phe | Thr | Ser | Asp | Tyr | Ser | Arg | Tyr | Leu | Asp | Ala | Arg | Arg | Ala | Gln | Glu | Phe | Ile | Glu | Trp | Leu | Leu | Gln | Ser |
| 327 | 5519 | 327 | | His | AiB | His | Gly | Thr | Phe | Thr | Ser | Asp | Tyr | Ser | Lys | Tyr | Leu | Asp | Ala | Arg | Arg | Ala | Gln | Glu | Phe | Ile | Glu | Trp | Leu | Leu | Gln | Ser |
| 328 | 5520 | 328 | | His | AiB | His | Gly | Thr | Phe | Thr | Ser | Asp | Tyr | Ser | Arg | Tyr | Leu | Asp | Ala | Arg | Arg | Ala | Gln | Glu | Phe | Ile | Glu | Trp | Leu | Leu | Gln | Ser |
| 329 | 5521 | 329 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 330 | 5522 | 330 | | His | AiB | His | Gly | Thr | Phe | Thr | Ser | Asp | Tyr | Ser | Arg | Tyr | Leu | Asp | Ala | Arg | Arg | Ala | Gln | Glu | Phe | Ile | Glu | Trp | Leu | Leu | Gln | Ser |
| 331 | 5523 | 331 | | His | AiB | His | Gly | Thr | Phe | Thr | Ser | Asp | Tyr | Ser | Arg | Tyr | Leu | Asp | Ala | Arg | Arg | Ala | Gln | Glu | Phe | Ile | Glu | Trp | Leu | Leu | Gln | Ser |
| 332 | 5524 | 332 | | His | AiB | His | Gly | Thr | Phe | Thr | Ser | Asp | Tyr | Ser | Arg | Tyr | Leu | Asp | Ala | Arg | Arg | Ala | Gln | Glu | Phe | Ile | Glu | Trp | Leu | Leu | Gln | Ser |
| 333 | 5525 | 333 | | His | AiB | His | Gly | Thr | Phe | Thr | Ser | Asp | Tyr | Ser | Arg | Tyr | Leu | Asp | Ala | Arg | Arg | Ala | Gln | Glu | Phe | Ile | Glu | Trp | Leu | Leu | Gln | Ser |
| 334 | 5526 | 334 | | His | AiB | His | Gly | Thr | Phe | Thr | Ser | Asp | Tyr | Ser | Arg | Tyr | Leu | Asp | Ala | Arg | Arg | Ala | Gln | Glu | Phe | Ile | Glu | Trp | Leu | Leu | Gln | Ser |
| 335 | 5527 | 335 | | His | AiB | His | Gly | Thr | Phe | Thr | Ser | Asp | Tyr | Ser | Arg | Tyr | Leu | Asp | Ala | Arg | Arg | Ala | Gln | Glu | Phe | Ile | Glu | Trp | Leu | Leu | Gln | Ser |
| 336 | 5528 | 336 | | His | AiB | His | Gly | Thr | Phe | Thr | Ser | Asp | Tyr | Ser | Arg | Tyr | Leu | Asp | Ala | Arg | Arg | Ala | Gln | Glu | Phe | Ile | Glu | Trp | Leu | Leu | Gln | Ser |
| 337 | 5529 | 337 | | His | AiB | His | Gly | Thr | Phe | Thr | Ser | Asp | Tyr | Ser | Arg | Tyr | Leu | Asp | Ala | Arg | Arg | Ala | Gln | Glu | Phe | Ile | Glu | Trp | Leu | Leu | Gln | Ser |
| 338 | 5530 | 338 | | His | AiB | His | Gly | Thr | Phe | Thr | Ser | Asp | Tyr | Ser | Arg | Tyr | Leu | Asp | Ala | Arg | Arg | Ala | Gln | Glu | Phe | Ile | Glu | Trp | Leu | Leu | Gln | Ser |
| 339 | 5531 | 339 | | His | AiB | His | Gly | Thr | Phe | Thr | Ser | Asp | Tyr | Ser | Arg | Tyr | Leu | Asp | Ala | Arg | Arg | Ala | Gln | Glu | Phe | Ile | Glu | Trp | Leu | Leu | Gln | Ser |
| 340 | 5532 | 340 | | His | AiB | His | Gly | Thr | Phe | Thr | Ser | Asp | Tyr | Ser | Lys | Tyr | Leu | Asp | Ala | Arg | Arg | Ala | Gln | Glu | Phe | Ile | Glu | Trp | Leu | Leu | Gln | Ser |
| 341 | 5534 | 341 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |

Figure 1 (Continued)

| 30 | 31 | 32 | 33 | 34 | 35 | 36 | 37 | 38 | 39 | 40 | 41 | 42 | 43 | 44 | 45 | 46 | 47 | 48 | Z | n (R=$C_n$) | Ex | 7.5nM single intake | 7.5nM single loss | 15nM single intake | 15nM single loss | 30nM single intake | 30nM single loss | rpt dose | Ratio Gluc/GLP-1 |
|----|----|----|----|----|----|----|----|----|----|----|----|----|----|----|----|----|----|----|---|---|----|---|---|---|---|---|---|---|---|
| His | His | Gln | His | His | Pro | Ser | Pro | Pro | Pro | Gly |  | Lys |  |  |  |  | Asn | His | i | 16 | 305 |  |  |  |  |  |  | 10 | 3 | 5 |
| His | His | His | His | His | Pro | Ser | Pro | Pro | Pro | Gly |  | Lys |  |  |  |  | Asn | His | i | 16 | 306 |  |  |  |  |  |  |  |  |  |
| His | His | His | His | His | Pro | Ser | Pro | Pro | Pro | Gly |  | Lys |  |  |  |  | Gly | Ser | i | 16 | 307 |  |  |  |  |  |  | 10 | 8 | 4 |
| His | His | Gln | His | His | Pro | Ser | Pro | Pro | Pro | Gly |  | Lys |  |  |  |  |  | Gln | i | 18 | 308 |  |  |  |  |  |  |  |  |  |
| His | His | His | His | His | Glu | Ser | Pro | Pro | Pro | Gly |  | Lys |  |  |  | Ser | Gly | Thr | i | 18 | 309 |  |  |  |  |  |  | 9 | 8 |  |
| His | His | Gln | His | His | Glu | Ser | Pro | Pro | Pro | Gly |  | Lys |  |  |  | Ser | Gly | Thr | i | 18 | 310 |  |  |  |  |  |  | 9 | 10 |  |
| His | His | His | His | His | Glu | Ser | Pro | Pro | Pro | Gly |  | Lys |  |  |  | Ser | Gly | Thr | i | 18 | 311 |  |  |  |  |  |  | 9 | 3 |  |
| His | His | Gln | His | His | Pro | Ser | Pro | Pro | Pro | Gly |  | Lys |  |  |  |  | Asn | His | i | 16 | 312 |  |  |  |  |  |  | 5 | 5 | 6 |
| His | His | His | His | His | Pro | Ser | Pro | Pro | Pro |  |  | Lys |  |  |  |  | Asn | His | i | 16 | 313 |  |  |  |  |  |  | 5 | 4 | 6 |
| His | His | His | His | His | Pro | Ser | Pro | Pro | Pro | Gly |  | Lys |  |  |  |  | Asn | His | i | 18 | 314 |  |  |  |  |  |  | 4 | 1 |  |
| His | His | Gln | His | His | Pro | Ser | Pro | Pro | Pro | Gly |  | Lys |  |  |  |  | Asn | His | i | 16 | 315 |  |  |  |  |  |  | 10 | 10 | 7 |
| His | His | His | His | His | Pro | Ser | Pro | Pro | Pro |  |  | Lys |  |  |  |  | Gln | His | i | 16 | 316 |  |  |  |  |  |  | 11 | 11 | 5 |
| His | His | His | His | His | Pro | Ser | Pro | Pro | Pro | Gly |  | Lys |  |  |  |  | Asn | His | i | 16 | 317 |  |  |  |  |  |  | 9 | 10 | 7 |
| His | His | Gln | His | His | Pro | Ser | Pro | Pro | Pro |  |  | Lys |  |  |  |  | Asn | His | i | 16 | 318 |  |  |  |  |  |  | 7 | 6 |  |
| His | His | His | His | His | Pro | Ser | Pro | Pro | Pro | Gly |  | Lys |  |  |  |  | Asn | His | i | 16 | 319 |  |  |  |  |  |  | 10 | 12 | 6 |
| His | His | Gln | His | His | Pro | Ser | Pro | Pro | Pro | Gly |  | Lys |  |  |  |  | Asn | His | i | 16 | 320 |  |  |  |  |  |  | 10 | 8 |  |
| His | His | His | His | His | Pro | Ser | Pro | Pro | Pro | Gly |  | Lys |  |  |  |  | Asn | His | i | 16 | 321 |  |  |  |  |  |  | 10 | 11 |  |
| His | His | Gln | His | His | Pro | Ser | Pro | Pro | Pro | Gly |  | Lys |  |  |  |  | Asn | His | i | 16 | 322 |  |  |  |  |  |  | 9 | 6 |  |
| His | His | His | His | His | Pro | Ser | Pro | Pro | Pro | Gly |  | Lys |  |  |  |  | Asn | His | i | 16 | 323 |  |  |  |  |  |  | 11 | 10 |  |
| His | His | Gln | His | His | Pro | Ser | Pro | Pro | Pro | Gly |  | Lys |  |  |  |  | Asn | His | i | 16 | 324 |  |  |  |  |  |  | 9 | 9 |  |
| His | His | His | His | His | Pro | Ser | Pro | Pro | Pro | Gly |  | Lys |  |  |  |  | Asn |  | i | 18 | 325 |  |  |  |  |  |  | 9 | 4 |  |
| His | His | Gln | His | His | Glu | Ser | Pro | Pro | Pro | Gly |  | Lys |  |  |  |  | Asn |  | i | 18 | 326 |  |  |  |  |  |  | 7 | 9 |  |
| His | His | His | His | His | Glu | Ser | Pro | Pro | Pro | Gly |  | Lys |  |  |  |  | Asn | His | i | 18 | 327 |  |  |  |  |  |  | 10 | 9 | 6 |
| His | His | Gln | His | His | Glu | Ser | Pro | Pro | Pro |  |  | Lys |  |  |  |  | Asn | His | i | 18 | 328 |  |  |  |  |  |  | 6 | 4 |  |
| His | His | His | His | His | Glu | Ser | Pro | Pro | Pro | Gly |  | Lys |  |  |  |  | Asn | His | i | 16 | 329 |  |  |  |  |  |  | 10 | 11 | 5 |
| His | His | Gln | His | His | Glu | Ser | Pro | Pro | Pro | Gly |  | Lys |  |  |  |  | Asn | His | i | 18 | 330 |  |  |  |  |  |  |  |  |  |
| His | His | His | His | His | Glu | Ser | Pro | Pro | Pro | Gly |  | Lys |  |  |  |  | Asn | His | i | 18 | 331 |  |  |  |  |  |  |  |  |  |
| His | His | Gln | His | His | Glu | Ser | Pro | Pro | Pro | Gly |  | Lys |  |  |  |  | Asn | His | i | 18 | 332 |  |  |  |  |  |  |  |  |  |
| His | His | His | His | His | Glu | Ser | Pro | Pro | Pro | Gly |  | Lys |  |  |  |  | Asn | His | i | 18 | 333 |  |  |  |  |  |  |  |  |  |
| His | His | Gln | His | His | Glu | Ser | Pro | Pro | Pro |  |  | Lys |  |  |  |  | Asn | His | i | 18 | 334 |  |  |  |  |  |  |  |  |  |
| His | His | His | His | His | Glu | Ser | Pro | Pro | Pro | Gly |  | Lys |  |  |  |  | Asn | His | i | 14 | 335 |  |  |  |  |  |  |  |  |  |
| His | His | Gln | His | His | Pro | Ser | Pro | Pro | Pro | Gly |  | Lys |  |  |  |  | Asn | His | i | 14 | 336 |  |  |  |  |  |  |  |  |  |
| His | His | His | His | His | Pro | Ser | Pro | Pro | Pro | Gly |  | Lys |  |  |  |  | Asn | His | i | 14 | 337 |  |  |  |  |  |  |  |  |  |
| His | His | Gln | His | His | Pro | Ser | Pro | Pro | Pro | Gly |  | Lys |  |  |  |  | Asn | His | i | 14 | 338 |  |  |  |  |  |  |  |  |  |
| His | His | His | His | His | Pro | Ser | Pro | Pro | Pro | Gly |  | Lys |  |  |  |  | Asn | His | i | 14 | 339 |  |  |  |  |  |  |  |  |  |
| His | His | Gln | His | His | Pro | Ser | Pro | Pro | Pro | Gly |  | Lys |  |  |  | Ser | Gly | Thr | i | 14 | 340 |  |  |  |  |  |  | 7 | 7 |  |
| His | His | His | His | His | Pro | Ser | Pro | Pro | Pro | Gly |  | Lys |  |  |  |  | Gly | Ser | i | 14 | 341 |  |  |  |  |  |  | 8 | 9 |  |

Figure 1 (Continued)

| Ex | G ref | SEQ ID | Note | 1 | 2 | 3 | 4 | 5 | 6 | 7 | 8 | 9 | 10 | 11 | 12 | 13 | 14 | 15 | 16 | 17 | 18 | 19 | 20 | 21 | 22 | 23 | 24 | 25 | 26 | 27 | 28 | 29 |
|---|---|---|---|---|---|---|---|---|---|---|---|---|---|---|---|---|---|---|---|---|---|---|---|---|---|---|---|---|---|---|---|---|
| 342 | 5535 | 342 | | His | AiB | His | Gly | Thr | Phe | Thr | Ser | Asp | Tyr | Ser | Arg | Tyr | Leu | Asp | Ala | Arg | Arg | Ala | Gln | Glu | Phe | Ile | Glu | Trp | Leu | Leu | Gln | Ser |
| 343 | 5536 | 343 | | His | AiB | His | Gly | Thr | Phe | Thr | Ser | Asp | Tyr | Ser | Arg | Tyr | Leu | Asp | Ala | Arg | Arg | Ala | Gln | Glu | Phe | Ile | Glu | Trp | Leu | Leu | Gln | Ser |
| 344 | 5537 | 344 | | His | AiB | His | Gly | Thr | Phe | Thr | Ser | Asp | Tyr | Ser | Arg | Tyr | Leu | Asp | Ala | Arg | Arg | Ala | Gln | Glu | Phe | Ile | Glu | Trp | Leu | Leu | Gln | Ser |
| 345 | 5538 | 345 | | His | AiB | His | Gly | Thr | Phe | Thr | Ser | Asp | Tyr | Ser | Arg | Tyr | Leu | Asp | Ala | Arg | Arg | Ala | Gln | Glu | Phe | Ile | Glu | Trp | Leu | Leu | Gln | Ser |
| 346 | 5539 | 346 | | His | AiB | His | Gly | Thr | Phe | Thr | Ser | Asp | Tyr | Ser | Arg | Tyr | Leu | Asp | Ala | Arg | Arg | Ala | Gln | Glu | Phe | Ile | Glu | Trp | Leu | Leu | Gln | Ser |
| 347 | 5540 | 347 | | His | AiB | His | Gly | Thr | Phe | Thr | Ser | Asp | Tyr | Ser | Arg | Tyr | Leu | Asp | Ala | Arg | Arg | Ala | Gln | Glu | Phe | Ile | Glu | Trp | Leu | Leu | Gln | Ser |
| 348 | 5541 | 348 | | His | AiB | His | Gly | Thr | Phe | Thr | Ser | Asp | Tyr | Ser | Arg | Tyr | Leu | Asp | Ala | Arg | Arg | Ala | Gln | Glu | Phe | Ile | Glu | Trp | Leu | Leu | Gln | Ser |
| 349 | 5542 | 349 | | His | AiB | His | Gly | Thr | Phe | Thr | Ser | Asp | Tyr | Ser | Arg | Tyr | Leu | Asp | Ala | Arg | Arg | Ala | Gln | Glu | Phe | Ile | Glu | Trp | Leu | Leu | Gln | Ser |
| 350 | 5543 | 350 | | His | AiB | His | Gly | Thr | Phe | Thr | Ser | Asp | Tyr | Ser | Arg | Tyr | Leu | Asp | Ala | Arg | Arg | Ala | Gln | Glu | Phe | Ile | Glu | Trp | Leu | Leu | Gln | Ser |
| 351 | 5544 | 351 | | His | AiB | His | Gly | Thr | Phe | Thr | Ser | Asp | Tyr | Ser | Arg | Tyr | Leu | Asp | Ala | Arg | Arg | Ala | Gln | Glu | Phe | Ile | Glu | Trp | Leu | Leu | Gln | Ser |
| 352 | 5545 | 352 | | His | AiB | His | Gly | Thr | Phe | Thr | Ser | Asp | Tyr | Ser | Arg | Tyr | Leu | Asp | Ala | Arg | Arg | Ala | Gln | Glu | Phe | Ile | Glu | Trp | Leu | Leu | Gln | Ser |
| 353 | 5546 | 353 | | His | AiB | His | Gly | Thr | Phe | Thr | Ser | Asp | Tyr | Ser | Arg | Tyr | Leu | Asp | Ala | Arg | Arg | Ala | Gln | Glu | Phe | Ile | Glu | Trp | Leu | Leu | Gln | Ser |
| 354 | 5547 | 354 | | His | AiB | His | Gly | Thr | Phe | Thr | Ser | Asp | Tyr | Ser | Arg | Tyr | Leu | Asp | Ala | Lys | Arg | Ala | Gln | Glu | Phe | Ile | Glu | Trp | Leu | Leu | Gln | Ser |
| 355 | 5548 | 355 | | His | AiB | His | Gly | Thr | Phe | Thr | Ser | Asp | Tyr | Ser | Arg | Tyr | Leu | Asp | Ala | Arg | Arg | Ala | Gln | Glu | Phe | Ile | Glu | Trp | Leu | Leu | Gln | Ser |
| 356 | 5549 | 356 | | His | AiB | His | Gly | Thr | Phe | Thr | Ser | Asp | Tyr | Ser | Arg | Tyr | Leu | Asp | Ala | Arg | Arg | Ala | Gln | Glu | Phe | Ile | Glu | Trp | Leu | Leu | Gln | Ser |
| 357 | 5550 | 357 | | His | AiB | His | Gly | Thr | Phe | Thr | Ser | Asp | Tyr | Ser | Arg | Tyr | Leu | Asp | Ala | Arg | Arg | Ala | Gln | Glu | Phe | Ile | Glu | Trp | Leu | Leu | Gln | Ser |
| 358 | 5551 | 358 | | His | AiB | His | Gly | Thr | Phe | Thr | Ser | Asp | Tyr | Ser | Arg | Tyr | Leu | Asp | Ala | Arg | Arg | Ala | Gln | Glu | Phe | Ile | Glu | Trp | Leu | Leu | Gln | Ser |
| 359 | 5552 | 359 | | His | AiB | His | Gly | Thr | Phe | Thr | Ser | Asp | Tyr | Ser | Arg | Tyr | Leu | Asp | Glu | Arg | Arg | Ala | Gln | Glu | Phe | Ile | Glu | Trp | Leu | Leu | Gln | Ser |
| 360 | 5553 | 360 | | His | AiB | His | Gly | Thr | Phe | Thr | Ser | Asp | Tyr | Ser | Arg | Tyr | Leu | Asp | Glu | Arg | Arg | Ala | Gln | Glu | Phe | Ile | Glu | Trp | Leu | Leu | Gln | Ser |
| 361 | 5554 | 361 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 362 | 5555 | 362 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 363 | 5556 | 363 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 364 | 5557 | 364 | | His | AiB | His | Gly | Thr | Phe | Thr | Ser | Asp | Tyr | Ser | Arg | Tyr | Leu | Asp | Ala | Lys | Arg | Ala | Gln | Glu | Phe | Ile | Glu | Trp | Leu | Leu | Gln | Ser |
| 365 | 5558 | 365 | | His | AiB | His | Gly | Thr | Phe | Thr | Ser | Asp | Tyr | Ser | Arg | Tyr | Leu | Asp | Ala | Lys | Arg | Ala | Gln | Glu | Phe | Ile | Glu | Trp | Leu | Leu | Gln | Ser |
| 366 | 5559 | 366 | | His | AiB | His | Gly | Thr | Phe | Thr | Ser | Asp | Tyr | Ser | Arg | Tyr | Leu | Asp | Ala | Lys | Arg | Ala | Gln | Glu | Phe | Ile | Glu | Trp | Leu | Leu | Gln | Ser |
| 367 | 5560 | 367 | | His | AiB | His | Gly | Thr | Phe | Thr | Ser | Asp | Tyr | Ser | Arg | Tyr | Leu | Asp | Ala | Lys | Arg | Ala | Gln | Glu | Phe | Ile | Glu | Trp | Leu | Leu | Gln | Ser |
| 368 | 5561 | 368 | | His | AiB | His | Gly | Thr | Phe | Thr | Ser | Asp | Tyr | Ser | Arg | Tyr | Leu | Asp | Ala | Lys | Arg | Ala | Gln | Glu | Phe | Ile | Glu | Trp | Leu | Leu | Gln | Ser |
| 369 | 5562 | 369 | | His | AiB | His | Gly | Thr | Phe | Thr | Ser | Asp | Tyr | Ser | Arg | Tyr | Leu | Asp | Ala | Lys | Arg | Ala | Gln | Glu | Phe | Ile | Glu | Trp | Leu | Leu | Gln | Ser |
| 370 | 5563 | 370 | | His | AiB | His | Gly | Thr | Phe | Thr | Ser | Asp | Tyr | Ser | Arg | Tyr | Leu | Asp | Ala | Lys | Arg | Ala | His | Glu | Phe | Ile | Glu | Trp | Leu | Leu | His | Gly |
| 371 | 5564 | 371 | | His | AiB | His | Gly | Thr | Phe | Thr | Ser | Asp | Tyr | Ser | Arg | Tyr | Leu | Asp | Ala | Lys | Arg | Ala | His | Glu | Phe | Ile | Glu | Trp | Leu | Leu | His | Gly |
| 372 | 5565 | 372 | | His | AiB | His | Gly | Thr | Phe | Thr | Ser | Asp | Tyr | Ser | Arg | Tyr | Leu | Asp | Ala | Lys | Arg | Ala | His | Glu | Phe | Ile | Glu | Trp | Leu | Leu | His | Gly |
| 373 | 5566 | 373 | | His | AiB | His | Gly | Thr | Phe | Thr | Ser | Asp | Tyr | Ser | Arg | Tyr | Leu | Asp | Ala | Lys | Arg | Ala | Gln | Glu | Phe | Ile | Glu | Trp | Leu | Leu | Gln | Ser |
| 374 | 5567 | 374 | | His | AiB | His | Gly | Thr | Phe | Thr | Ser | Asp | Tyr | Ser | Arg | Tyr | Leu | Asp | Ala | Lys | Arg | Ala | Gln | Glu | Phe | Ile | Glu | Trp | Leu | Leu | Gln | Ser |
| 375 | 5568 | 375 | | His | AiB | His | Gly | Thr | Phe | Thr | Ser | Asp | Tyr | Ser | Arg | Tyr | Leu | Asp | Ala | Lys | Arg | Ala | Gln | Glu | Phe | Ile | Glu | Trp | Leu | Leu | Gln | Ser |
| 376 | 5569 | 376 | | His | AiB | His | Gly | Thr | Phe | Thr | Ser | Asp | Tyr | Ser | Arg | Tyr | Leu | Asp | Ala | Lys | Arg | Ala | Gln | Glu | Phe | Ile | Glu | Trp | Leu | Leu | Gln | Ser |
| 377 | 5570 | 377 | | His | AiB | His | Gly | Thr | Phe | Thr | Ser | Asp | Tyr | Ser | Arg | Tyr | Leu | Asp | Ala | Lys | Arg | Ala | Gln | Glu | Phe | Ile | Glu | Trp | Leu | Leu | Gln | Ser |
| 378 | 5571 | 378 | | His | AiB | His | Gly | Thr | Phe | Thr | Ser | Asp | Tyr | Ser | Arg | Tyr | Leu | Asp | Ala | Lys | Arg | Ala | Gln | Glu | Phe | Ile | Glu | Trp | Leu | Leu | Gln | Ser |
| 379 | 5572 | 379 | | His | AiB | His | Gly | Thr | Phe | Thr | Ser | Asp | Tyr | Ser | Arg | Tyr | Leu | Asp | Ala | Lys | Arg | Ala | Gln | Glu | Phe | Ile | Glu | Trp | Leu | Leu | Gln | Ser |

Figure 1 (Continued)

| 30 | 31 | 32 | 33 | 34 | 35 | 36 | 37 | 38 | 39 | 40 | 41 | 42 | 43 | 44 | 45 | 46 | 47 | 48 | Z | n (R=Cn) | Ex | 7.5nM single intake | 7.5nM single loss | 15nM single intake | 15nM single loss | 30nM single intake | 30nM single loss | rpt dose intake | rpt dose loss | Ratio Gluc/GLP-1 |
|---|---|---|---|---|---|---|---|---|---|---|---|---|---|---|---|---|---|---|---|---|---|---|---|---|---|---|---|---|---|---|
| His | His | Gln | His | His | Pro | Ser | Pro | Pro | Pro |  |  | Lys |  |  | Thr | Gly | Ser | Gly | i | 14 | 342 |  |  |  |  |  |  |  |  |  |
| His | His | Gln | His | His | Pro | Ser | Pro | Pro | Pro |  |  | Lys |  |  | Thr | Gly | Ser | Gly | i | 18 | 343 |  |  |  |  |  |  |  |  |  |
| His | His | Gln | His | His | Pro | Ser | Pro | Pro | Pro |  |  | Lys |  |  | Thr | Gly | Ser | Gly | i | 16 | 344 |  |  |  |  |  |  |  |  |  |
| His | His | Gln | His | His | Pro | Ser | Pro | Pro | Pro |  |  | Lys |  |  |  |  |  | Asn | i | 18 | 345 |  |  |  |  |  |  |  |  |  |
| His | His | Gln | His | His | Glu | Ser | Pro | Pro | Pro |  |  | Lys |  |  |  |  | Ser | Gly | i | 16 | 346 |  |  |  |  |  |  |  |  |  |
| His | His | Gln | His | His | Pro | Ser | Pro | Pro | Pro |  |  | Lys |  |  |  |  | Ser | Gly | i | 18 | 347 |  |  |  |  |  |  |  |  |  |
| His | His | Gln | His | His | Pro | Ser | Pro | Pro | Pro |  |  | Lys |  |  |  |  | Ser | Gly | i | 16 | 348 |  |  |  |  |  |  |  |  |  |
| His | His | Gln | His | His | Glu | Ser | Pro | Pro | Pro |  |  | Lys |  |  |  |  | Ser | Gly | i | 14 | 349 |  |  |  |  |  |  |  |  |  |
| His | His | Gln | His | His | Pro | Ser | Pro | Pro | Pro | Gly |  | Lys |  |  |  |  |  | Asn | i | 16 | 350 |  |  |  |  |  |  |  |  |  |
| His | His | Gln | His | His | Pro | Ser | Pro | Pro | Pro | Gly |  | Lys |  |  |  |  |  | Asn | i | 14 | 351 |  |  |  |  |  |  |  |  |  |
| His | His | Gln | His | His | Pro | Ser | Pro | Pro | Pro | Gly |  | Lys |  |  |  |  |  | Asn | i | 16 | 352 |  |  |  |  |  |  |  |  |  |
| His | His | Gln | His | His | Pro | Ser | Pro | Pro | Pro | Gly |  | Lys |  |  |  |  |  | Asn | i | 18 | 353 |  |  |  |  |  |  |  |  |  |
| His | His | Gln | His | His | Glu | Ser | Pro | Pro | Pro | Gly |  | Lys |  |  | Thr | Gly | Ser | Gly | i | 16 | 354 |  |  |  |  |  |  | 3 | 1 |  |
| His | His | Gln | His | His | Pro | Ser | Pro | Pro | Pro | Gly |  | Lys |  |  |  |  |  | Gln | i | 18 | 355 |  |  |  |  |  |  |  |  |  |
| His | His | Gln | His | His | Pro | Ser | Pro | Pro | Pro | Gly |  | Lys |  |  |  |  |  | Gln | i | 16 | 356 |  |  |  |  |  |  |  |  |  |
| His | His | Gln | His | His | Pro | Ser | Pro | Pro | Pro | Gly |  | Lys |  |  | Thr | Gly | Ser | Gly | i | 18 | 357 |  |  |  |  |  |  |  |  |  |
| His | His | Gln | His | His | Pro | Ser | Pro | Pro | Pro | Gly |  | Lys |  |  | Thr | Gly | Ser | Gly | i | 16 | 358 |  |  |  |  |  |  |  |  |  |
| His | His | Gln | His | His | Pro | Ser | Pro | Pro | Pro | Gly |  | Lys |  |  |  |  | Gly | Ser | i | 14 | 359 |  |  |  |  |  |  |  |  |  |
| His | His | Gln | His | His | Pro | Ser | Pro | Pro | Pro | Gly |  | Lys |  |  |  |  | Gly | Ser | i | 18 | 360 |  |  |  |  |  |  |  |  |  |
| His | His | Gln | His | His | Pro | Ser | Pro | Pro | Pro |  |  | Lys |  |  |  |  |  | Asn | i | 16 | 361 |  |  |  |  |  |  |  |  |  |
| His | His | Gln | His | His | Pro | Ser | Pro | Pro | Pro |  |  | Lys |  |  |  |  |  | Gln | i | 18 | 362 |  |  |  |  |  |  |  |  |  |
| His | His | Gln | His | His | Ala | Ser | Gly |  |  |  |  | Lys |  |  |  | Ser | Gly | Thr | i | 14 | 363 |  |  |  |  |  |  | 2 | 0 |  |
| His | His | Gln | His | His | Ala | Ser | Gly |  |  |  |  | Lys |  |  |  | Ser | Gly | Thr | i | 16 | 364 |  |  |  |  |  |  |  |  |  |
| His | His | Gln | His | His | Ala | Ser | Gly |  |  |  |  | Lys |  |  |  | Ser | Gly | Thr | i | 16 | 365 |  |  |  |  |  |  |  |  |  |
| His | His | Gln | His | His | Pro | Ser | Pro | Pro | Pro | Gly |  | Lys |  |  | Thr | Gly | Ser | Ser | i | 16 | 366 |  |  |  |  |  |  | 11 | 12 |  |
| His | His | Gln | His | His | Pro | Ser | Pro | Pro | Pro | Gly |  | Lys |  |  |  |  | Gly | Gly | i | 16 | 367 |  |  |  |  |  |  | 12 | 11 |  |
| His | His | Gln | His | His | Pro | Ser | Pro | Pro | Pro | Gly |  | Lys |  |  |  |  |  | Asn | i | 16 | 368 |  |  |  |  |  |  | 11 | 10 |  |
| His | His | Gln | His | His | Pro | Ser | Pro | Pro | Pro | Gly |  | Lys |  |  |  |  |  | Gln | i | 16 | 369 |  |  |  |  |  |  | 9 | 10 |  |
| His | His | Gln | His | His | Pro | Ser | Pro | Pro | Pro | Gly |  | Lys |  |  | Thr | Gly | Gly | Ser | i | 18 | 370 |  |  |  |  |  |  | 8 | 6 |  |
| His | His | Gln | His | His | Pro | Ser | Pro | Pro | Pro |  |  | Lys |  |  |  |  | Ser | Gly | i | 14 | 371 |  |  |  |  |  |  | 4 | 3 |  |
| His | His | Gln | His | His | Pro | Ser | Pro | Pro | Pro |  |  | Lys |  |  |  |  |  | Asn | i | 16 | 372 |  |  |  |  |  |  | 11 | 12 |  |
| His | His | Gln | His | His | Pro | Ser | Pro | Pro | Pro |  |  | Lys |  |  |  |  |  | Gln | i | 16 | 373 |  |  |  |  |  |  | 9 | 7 |  |
| His | His | Gln | His | His | Pro | Ser | Pro | Pro | Pro |  |  | Lys |  |  |  |  | Asn | His | i | 16 | 374 |  |  |  |  |  |  | 7 | 6 |  |
| His | His | Gln | His | His | Pro | Ser | Pro | Pro | Pro | Gly |  | Lys |  |  |  |  | Gly | Ser | i | 16 | 375 |  |  |  |  |  |  | 8 | 7 |  |
| His | His | Gln | His | His | Pro | Ser | Pro | Pro | Pro | Gly |  | Lys |  |  | Thr |  | Ser | Gly | i | 16 | 376 |  |  |  |  |  |  | 9 | 9 |  |
| His | His | Gln | His | His | Pro | Ser | Pro | Pro | Pro | Gly |  | Lys |  |  |  |  |  | Asn | i | 16 | 377 |  |  |  |  |  |  | 10 | 11 |  |
| His | His | Gln | His | His | Pro | Ser | Pro | Pro | Pro | Gly |  | Lys |  |  |  |  |  | Gln | i | 16 | 378 |  |  |  |  |  |  | 7 | 8 |  |
| His | His | Gln | His | His | Pro | Ser | Pro | Pro | Pro | Gly |  | Lys |  |  |  |  | Asn | His | i | 16 | 379 |  |  |  |  |  |  | 10 | 10 |  |

Figure 1 (Continued)

| Ex | G ref | SEQ ID | Note | 1 | 2 | 3 | 4 | 5 | 6 | 7 | 8 | 9 | 10 | 11 | 12 | 13 | 14 | 15 | 16 | 17 | 18 | 19 | 20 | 21 | 22 | 23 | 24 | 25 | 26 | 27 | 28 | 29 |
|----|-------|--------|------|---|---|---|---|---|---|---|---|---|----|----|----|----|----|----|----|----|----|----|----|----|----|----|----|----|----|----|----|----|
| 380 | 5573 | 380 | | His | AiB | His | Gly | Thr | Phe | Thr | Ser | Asp | Tyr | Ser | Arg | Tyr | Leu | Asp | Ala | Lys | Arg | Ala | Gln | Glu | Phe | Ile | Glu | Trp | Leu | Leu | Gln | Ser |
| 381 | 5574 | 381 | | His | AiB | His | Gly | Thr | Phe | Thr | Ser | Asp | Tyr | Ser | Arg | Tyr | Leu | Asp | Ala | Lys | Arg | Ala | Gln | Glu | Phe | Ile | Glu | Trp | Leu | Leu | Gln | Ser |
| 382 | 5575 | 382 | | His | AiB | His | Gly | Thr | Phe | Thr | Ser | Asp | Tyr | Ser | Arg | Tyr | Leu | Asp | Ala | Lys | Arg | Ala | Gln | Glu | Phe | Ile | Glu | Trp | Leu | Leu | Gln | Ser |
| 383 | 5576 | 383 | | His | AiB | His | Gly | Thr | Phe | Thr | Ser | Asp | Tyr | Ser | Arg | Tyr | Leu | Asp | Ala | Lys | Arg | Ala | Gln | Glu | Phe | Ile | Glu | Trp | Leu | Leu | Gln | Ser |
| 384 | 5577 | 384 | | His | AiB | His | Gly | Thr | Phe | Thr | Ser | Asp | Tyr | Ser | Arg | Tyr | Leu | Asp | Ala | Lys | Arg | Ala | Gln | Glu | Phe | Ile | Glu | Trp | Leu | Leu | Gln | Ser |
| 385 | 5578 | 385 | | His | AiB | His | Gly | Thr | Phe | Thr | Ser | Asp | Tyr | Ser | Arg | Tyr | Leu | Asp | Glu | Lys | Arg | Ala | His | Glu | Phe | Ile | Glu | Trp | Leu | Leu | His | Gly |
| 386 | 5579 | 386 | | His | AiB | His | Gly | Thr | Phe | Thr | Ser | Asp | Tyr | Ser | Arg | Tyr | Leu | Asp | Glu | Lys | Arg | Ala | His | Glu | Phe | Ile | Glu | Trp | Leu | Leu | His | Gly |
| 387 | 5580 | 387 | | His | AiB | His | Gly | Thr | Phe | Thr | Ser | Asp | Tyr | Ser | Arg | Tyr | Leu | Asp | Glu | Lys | Arg | Ala | His | Glu | Phe | Ile | Glu | Trp | Leu | Leu | His | Gly |
| 388 | 5581 | 388 | | His | AiB | His | Gly | Thr | Phe | Thr | Ser | Asp | Tyr | Ser | Arg | Tyr | Leu | Asp | Ala | Lys | Arg | Ala | Gln | Glu | Phe | Ile | Glu | Trp | Leu | Leu | Gln | Ser |
| 389 | 5582 | 389 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 390 | 5583 | 390 | | His | AiB | His | Gly | Thr | Phe | Thr | Ser | Asp | Tyr | Ser | Arg | Tyr | Leu | Asp | Ala | Arg | Arg | Ala | Gln | Glu | Phe | Ile | Glu | Trp | Leu | Leu | Gln | Ser |
| 391 | 5584 | 391 | | His | AiB | His | Gly | Thr | Phe | Thr | Ser | Asp | Tyr | Ser | Lys | Tyr | Leu | Asp | Ala | Arg | Arg | Ala | Gln | Glu | Phe | Ile | Glu | Trp | Leu | Leu | Gln | Ser |
| 392 | 5585 | 392 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 393 | 5586 | 393 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 394 | 5587 | 394 | | His | AiB | His | Gly | Thr | Phe | Thr | Ser | Asp | Tyr | Ser | Arg | Tyr | Leu | Asp | Ala | Lys | Arg | Ala | Gln | Glu | Phe | Ile | Glu | Trp | Leu | Leu | Gln | Ser |
| 395 | 5588 | 395 | | His | AiB | His | Gly | Thr | Phe | Thr | Ser | Asp | Tyr | Ser | Arg | Tyr | Leu | Asp | Ala | Lys | Arg | Ala | Gln | Glu | Phe | Ile | Glu | Trp | Leu | Leu | Gln | Ser |
| 396 | 5589 | 396 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 397 | 5590 | 397 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 398 | 5591 | 398 | | His | AiB | His | Gly | Thr | Phe | Thr | Ser | Asp | Tyr | Ser | Arg | Tyr | Leu | Asp | Ala | Lys | Arg | Ala | Gln | Glu | Phe | Ile | Glu | Trp | Leu | Leu | Gln | Ser |
| 399 | 5592 | 399 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 400 | 5593 | 400 | Ex263 Cl | His | AiB | His | Gly | Thr | Phe | Thr | Ser | Asp | Tyr | Ser | Arg | Tyr | Leu | Asp | Ala | Lys | Arg | Ala | Gln | Glu | Phe | Ile | Glu | Trp | Leu | Leu | Gln | Ser |
| 401 | 5594 | 401 | Ex289 Cl | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 402 | 5595 | 402 | Ex307 Cl | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 403 | 5596 | 403 | Ex319 Cl | His | AiB | His | Gly | Thr | Phe | Thr | Ser | Asp | Tyr | Ser | Arg | Tyr | Leu | Asp | Ala | Lys | Arg | Ala | Gln | Glu | Phe | Ile | Glu | Trp | Leu | Leu | Gln | Ser |
| 404 | 5597 | 404 | Ex323 Cl | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 405 | 5321 | 405 | | His | AiB | His | Gly | Thr | Phe | Thr | Ser | Asp | Tyr | Ser | Lys | Tyr | Leu | Asp | Gln | Arg | Arg | Ala | His | Glu | Phe | Ile | Glu | Trp | Leu | Leu | Asn | Ser |

Figure 1 (Continued)

| 30 | 31 | 32 | 33 | 34 | 35 | 36 | 37 | 38 | 39 | 40 | 41 | 42 | 43 | 44 | 45 | 46 | 47 | 48 | Z | n (R=C$_n$) | Ex | 7.5nM single intake | loss | 15nM single intake | loss | 30nM single intake | loss | rpt dose | | Ratio Gluc/GLP-1 |
|---|---|---|---|---|---|---|---|---|---|---|---|---|---|---|---|---|---|---|---|---|---|---|---|---|---|---|---|---|---|---|
| His | His | Gln | His | His | Pro | Ser | Pro | Pro | Pro | | | Lys | | | | | Gly | Ser | i | 18 | 380 | | | | | | | 5 | 4 | |
| His | His | Gln | His | His | Pro | Ser | Pro | Pro | Pro | | | Lys | | | Thr | Gly | Ser | Gly | i | 18 | 381 | | | | | | | 6 | 4 | |
| His | His | Gln | His | His | Pro | Ser | Pro | Pro | Pro | | | Lys | | | | | | Asn | i | 18 | 382 | | | | | | | 7 | 4 | |
| His | His | Gln | His | His | Pro | Ser | Pro | Pro | Pro | | | Lys | | | | | | Gln | i | 18 | 383 | | | | | | | 5 | 4 | |
| His | His | Gln | His | His | Pro | Ser | Pro | Pro | | | | Lys | | | | | Asn | His | i | 18 | 384 | | | | | | | 5 | 4 | |
| His | His | Gln | His | His | Ala | Ser | Gly | | | | | Lys | | | | Ser | Gly | Thr | i | 16 | 385 | | | | | | | | | |
| His | His | Gln | His | His | Ala | Ser | Gly | | | | | Lys | | | | Ser | Gly | Thr | i | 14 | 386 | | | | | | | | | |
| His | His | Gln | His | His | Ala | Ser | Gly | | | | | Lys | | | | Ser | Gly | Thr | i | 18 | 387 | | | | | | | | | |
| His | His | Gln | His | His | Pro | Ser | Pro | Pro | Pro | | | Lys | | | | | | Gln | i | 14 | 388 | | | | | | | | | |
| His | His | Gln | His | His | Pro | Ser | Pro | Pro | Pro | | | Lys | | | | | | Gln | i | 18 | 389 | | | | | | | | | |
| His | His | Gln | His | His | Pro | Ser | Pro | Pro | Pro | | | Lys | | | | | | Gln | i | 18 | 390 | | | | | | | | | |
| His | His | Gln | His | His | Pro | Ser | Pro | Pro | Pro | | | Lys | | | | | | Gln | i | 14 | 391 | | | | | | | | | |
| His | His | Gln | His | His | Pro | Ser | Pro | Pro | Pro | Gly | | Lys | | | | | | Gln | i | 16 | 392 | | | | | | | | | |
| His | His | Gln | His | His | Pro | Ser | Pro | Pro | Pro | Gly | | Lys | | | | | | Gln | i | 14 | 393 | | | | | | | | | |
| His | His | Gln | His | His | Pro | Ser | Pro | Pro | Pro | Gly | | Lys | | | | | Asn | His | i | 18 | 394 | | | | | | | | | |
| His | His | Gln | His | His | Pro | Ser | Pro | Pro | Pro | | | Lys | | | | | Gly | Ser | i | 18 | 395 | | | | | | | | | |
| His | His | Gln | His | His | Pro | Ser | Pro | Pro | Pro | | | Lys | | | | | Asn | His | i | 14 | 396 | | | | | | | | | |
| His | His | Gln | His | His | Pro | Ser | Pro | Pro | Pro | | | Lys | | | | | Gly | Ser | i | 14 | 397 | | | | | | | | | |
| His | His | Gln | His | His | Pro | Ser | Pro | Pro | Pro | Gly | | Lys | | | | | Asn | His | i | 14 | 398 | | | | | | | | | |
| His | His | Gln | His | His | Pro | Ser | Pro | Pro | Pro | Gly | | Lys | | | | | Asn | Gln | i | 18 | 399 | | | | | | | | | |
| His | His | Gln | His | His | Pro | Ser | Pro | Pro | Pro | | | Lys | | | | Ser | Gly | Thr | i | 18 | 400 | | | | | | | | | |
| His | His | Gln | His | His | Pro | Ser | Pro | Pro | Pro | | | Lys | | | | | Gly | Ser | i | 16 | 401 | | | | | | | | | |
| His | His | Gln | His | His | Glu | Ser | Pro | Pro | Pro | | | Lys | | | | | Asn | His | i | 16 | 402 | | | | | | | | | |
| His | His | Gln | His | His | Pro | Ser | Pro | Pro | Pro | Gly | | Lys | | | | | Asn | His | i | 16 | 403 | | | | | | | | | |
| His | His | Gln | His | His | Glu | Ser | Pro | Pro | Pro | | | Lys | | | | | Asn | His | i | 16 | 404 | -3 | -10 | | | -18 | -30 | 8 | 9 | 3 |
| Gly | His | Gln | His | His | His | Thr | | | | | | Lys | | | | | Gly | Ser | i | 16 | 405 | | | | | | | | | |

Figure 2

| Ex | G ref | SEQ ID | Note | 1 | 2 | 3 | 4 | 5 | 6 | 7 | 8 | 9 | 10 | 11 | 12 | 13 | 14 | 15 | 16 | 17 | 18 | 19 | 20 | 21 | 22 | 23 | 24 | 25 | 26 | 27 | 28 | 29 |
|---|---|---|---|---|---|---|---|---|---|---|---|---|---|---|---|---|---|---|---|---|---|---|---|---|---|---|---|---|---|---|---|---|
| 406 | 5598 | 406 | | His | AiB | His | Gly | Thr | Phe | Thr | Ser | Asp | Tyr | Ser | Lys | Tyr | Leu | Asp | Gln | Arg | Arg | Ala | His | Glu | Phe | Ile | Glu | Trp | Leu | Leu | Asn | Ser |
| 407 | 5599 | 407 | Ex316Cl | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 408 | 5600 | 408 | Ex366Cl | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 409 | 5601 | 409 | Ex372Cl | His | AiB | His | Gly | Thr | Phe | Thr | Ser | Asp | Tyr | Ser | Arg | Tyr | Leu | Asp | Ala | Lys | Arg | Ala | Gln | Glu | Phe | Ile | Glu | Trp | Leu | Leu | Gln | Ser |
| 410 | 5602 | 410 | Ex377Cl | His | AiB | His | Gly | Thr | Phe | Thr | Ser | Asp | Tyr | Ser | Arg | Tyr | Leu | Asp | Ala | Lys | Arg | Ala | Gln | Glu | Phe | Ile | Glu | Trp | Leu | Leu | Gln | Ser |
| 411 | 5603 | 411 | Ex367Cl | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 412 | 5604 | 412 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 413 | 5605 | 413 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 414 | 5606 | 414 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 415 | 5607 | 415 | | His | AiB | His | Gly | Thr | Phe | Thr | Ser | Asp | Tyr | Ser | Lys | Tyr | Leu | Asp | Gln | Lys | Arg | Ala | Gln | Glu | Phe | Ile | Glu | Trp | Leu | Leu | Gln | Ser |
| 416 | 5608 | 416 | | His | AiB | His | Gly | Thr | Phe | Thr | Ser | Asp | Tyr | Ser | Lys | Tyr | Leu | Asp | Glu | Lys | Arg | Ala | Gln | Glu | Phe | Ile | Glu | Trp | Leu | Leu | Gln | Ser |
| 417 | 5609 | 417 | | His | AiB | Gln | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 418 | 5610 | 418 | | His | AiB | Glu | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 419 | 5611 | 419 | | His | AiB | Gln | Gly | Thr | Phe | Thr | Ser | Asp | Tyr | Ser | Lys | Tyr | Leu | Asp | Gln | Lys | Arg | Ala | Gln | Glu | Phe | Ile | Glu | Trp | Leu | Leu | Gln | Ser |
| 420 | 5612 | 420 | | His | AiB | His | Gly | Thr | Phe | Thr | Ser | Asp | Tyr | Ser | Lys | Tyr | Leu | Asp | Gln | Lys | Arg | Ala | Gln | Glu | Phe | Ile | Glu | Trp | Leu | Leu | Gln | Ser |
| 421 | 5613 | 421 | | His | AiB | His | Gly | Thr | Phe | Thr | Ser | Asp | Tyr | Ser | Arg | Tyr | Leu | Asp | Gln | Arg | Arg | Ala | Gln | Glu | Phe | Ile | Glu | Trp | Leu | Leu | Gln | Ser |
| 422 | 5614 | 422 | | His | AiB | His | Gly | Thr | Phe | Thr | Ser | Asp | Tyr | Ser | Arg | Tyr | Leu | Asp | Gln | Lys | Arg | Ala | Gln | Glu | Phe | Ile | Glu | Trp | Leu | Leu | Gln | Ser |
| 423 | 5615 | 423 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 424 | 5616 | 424 | | His | AiB | His | Gly | Thr | Phe | Thr | Ser | Asp | Tyr | Ser | Lys | Tyr | Leu | Asp | Glu | Lys | Arg | Ala | Gln | Glu | Phe | Ile | Glu | Trp | Leu | Leu | Gln | Ser |
| 425 | 5617 | 425 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 426 | 5618 | 426 | | His | AiB | His | Gly | Thr | Phe | Thr | Ser | Asp | Tyr | Ser | Lys | Tyr | Leu | Asp | Glu | Lys | Arg | Ala | Gln | Glu | Phe | Ile | Glu | Trp | Leu | Leu | Gln | Ser |
| 427 | 5619 | 427 | | His | AiB | His | Gly | Thr | Phe | Thr | Ser | Asp | Tyr | Ser | Lys | Tyr | Leu | Asp | Ala | Lys | Arg | Ala | His | Glu | Phe | Ile | Glu | Trp | Leu | Leu | His | Gly |
| 428 | 5620 | 428 | | His | AiB | His | Gly | Thr | Phe | Thr | Ser | Asp | Tyr | Ser | Lys | Tyr | Leu | Asp | Ala | Lys | Arg | Ala | His | Glu | Phe | Ile | Glu | Trp | Leu | Leu | His | Gly |
| 429 | 5621 | 429 | | His | AiB | His | Gly | Thr | Phe | Thr | Ser | Asp | Tyr | Ser | Lys | Tyr | Leu | Asp | Glu | Lys | Arg | Ala | His | Glu | Phe | Ile | Glu | Trp | Leu | Leu | His | Gly |
| 430 | 5622 | 430 | | His | AiB | His | Gly | Thr | Phe | Thr | Ser | Asp | Tyr | Ser | Lys | Tyr | Leu | Asp | Glu | Lys | Arg | Ala | His | Glu | Phe | Ile | Glu | Trp | Leu | Leu | His | Gly |
| 431 | 5623 | 431 | | His | AiB | His | Gly | Thr | Phe | Thr | Ser | Asp | Tyr | Ser | Lys | Tyr | Leu | Asp | Glu | Arg | Arg | Ala | His | Glu | Phe | Ile | Glu | Trp | Leu | Leu | His | Gly |
| 432 | 5624 | 432 | | His | AiB | His | Gly | Thr | Phe | Thr | Ser | Asp | Tyr | Ser | Arg | Tyr | Leu | Asp | Glu | Arg | Arg | Ala | His | Glu | Phe | Ile | Glu | Trp | Leu | Leu | His | Gly |
| 433 | 5625 | 433 | | His | AiB | His | Gly | Thr | Phe | Thr | Ser | Asp | Tyr | Ser | Arg | Tyr | Leu | Asp | Glu | Arg | Arg | Ala | His | Glu | Phe | Ile | Glu | Trp | Leu | Leu | His | Gly |
| 434 | 5626 | 434 | | His | AiB | His | Gly | Thr | Phe | Thr | Ser | Asp | Tyr | Ser | Arg | Tyr | Leu | Asp | Ala | Arg | Arg | Ala | His | Glu | Phe | Ile | Glu | Trp | Leu | Leu | His | Gly |
| 435 | 5627 | 435 | | His | AiB | His | Gly | Thr | Phe | Thr | Ser | Asp | Tyr | Ser | Arg | Tyr | Leu | Asp | Ala | Arg | Arg | Ala | His | Glu | Phe | Ile | Glu | Trp | Leu | Leu | His | Gly |
| 436 | 5628 | 436 | | His | AiB | His | Gly | Thr | Phe | Thr | Ser | Asp | Tyr | Ser | Lys | Tyr | Leu | Asp | Glu | Arg | Arg | Ala | His | Glu | Phe | Ile | Glu | Trp | Leu | Leu | His | Gly |
| 437 | 5629 | 437 | | His | AiB | His | Gly | Thr | Phe | Thr | Ser | Asp | Tyr | Ser | Lys | Tyr | Leu | Asp | Ala | Arg | Arg | Ala | His | Glu | Phe | Ile | Glu | Trp | Leu | Leu | His | Gly |
| 438 | 5630 | 438 | | His | AiB | His | Gly | Thr | Phe | Thr | Ser | Asp | Tyr | Ser | Lys | Tyr | Leu | Asp | Glu | Arg | Arg | Ala | His | Glu | Phe | Ile | Glu | Trp | Leu | Leu | His | Gly |
| 439 | 5631 | 439 | | His | AiB | His | Gly | Thr | Phe | Thr | Ser | Asp | Tyr | Ser | Arg | Tyr | Leu | Asp | Ala | Arg | Arg | Ala | His | Glu | Phe | Ile | Glu | Trp | Leu | Leu | His | Gly |
| 440 | 5632 | 440 | | His | AiB | His | Gly | Thr | Phe | Thr | Ser | Asp | Tyr | Ser | Arg | Tyr | Leu | Asp | Ala | Arg | Arg | Ala | His | Glu | Phe | Ile | Glu | Trp | Leu | Leu | His | Gly |
| 441 | 5633 | 441 | | His | AiB | His | Gly | Thr | Phe | Thr | Ser | Asp | Tyr | Ser | Lys | Tyr | Leu | Asp | Ala | Arg | Arg | Ala | His | Glu | Phe | Ile | Glu | Trp | Leu | Leu | His | Gly |
| 442 | 5634 | 442 | | His | AiB | His | Gly | Thr | Phe | Thr | Ser | Asp | Tyr | Ser | Arg | Tyr | Leu | Asp | Ala | Arg | Arg | Ala | His | Glu | Phe | Ile | Glu | Trp | Leu | Leu | Asn | Ser |
| 443 | 5635 | 443 | | His | AiB | His | Gly | Thr | Phe | Thr | Ser | Asp | Tyr | Ser | Lys | Tyr | Leu | Asp | Ala | Lys | Arg | Ala | His | Glu | Phe | Ile | Glu | Trp | Leu | Leu | His | Gly |
| 444 | 5636 | 444 | | His | AiB | His | Gly | Thr | Phe | Thr | Ser | Asp | Tyr | Ser | Lys | Tyr | Leu | Asp | Gly | Arg | Arg | Ala | His | Glu | Phe | Ile | Glu | Trp | Leu | Leu | His | Gly |
| 445 | 5637 | 445 | | His | AiB | His | Gly | Thr | Phe | Thr | Ser | Asp | Tyr | Ser | Lys | Tyr | Leu | Asp | Gly | Lys | Arg | Ala | Gln | Glu | Phe | Ile | Glu | Trp | Leu | Leu | Gln | Ser |

Figure 2 (Continued)

| 30 | 31 | 32 | 33 | 34 | 35 | 36 | 37 | 38 | 39 | 40 | 41 | 42 | 43 | 44 | 45 | 46 | 47 | 48 | Z | n (R=C$_n$) | Ex | n | potent | food |
|---|---|---|---|---|---|---|---|---|---|---|---|---|---|---|---|---|---|---|---|---|---|---|---|---|
| Gly | His | His | His | His | His | Thr | | | | | | | | | | | | | - | 16 | 406 | | | |
| His | His | His | His | His | Pro | Ser | Pro | Pro | Pro | Gly | | Lys | | | | | Gly | Ser | - | 16 | 407 | | | |
| His | His | Gln | His | His | Pro | Ser | Pro | Pro | Pro | | | Lys | | | | | Gln | His | - | 16 | 408 | | | |
| His | His | Gln | His | His | Pro | Ser | Pro | Pro | Pro | | | Lys | | | | | Gly | Ser | - | 16 | 409 | | | |
| His | His | Gln | His | His | Pro | Ser | Pro | Pro | Pro | Gly | | Lys | | | | | | Asn | - | 16 | 410 | | | |
| His | His | Gln | His | His | Pro | Ser | Pro | Pro | Pro | | | Lys | | | Thr | Gly | Ser | Gly | - | 16 | 411 | 6 | 9 | 8 |
| His | His | Gln | His | His | Pro | Ser | Pro | Pro | Pro | | | Lys | | | Thr | Gly | Ser | Gly | - | 18 | 412 | 1 | 10 | 9 |
| His | His | Gln | His | His | Pro | Ser | Pro | Pro | Pro | | | Lys | | | Thr | | | Asn | - | 16 | 413 | | | |
| His | His | Gln | His | His | Pro | Ser | Pro | Pro | Pro | | | Lys | | | Gly | Ser | Gly | Thr | - | 16 | 414 | | | |
| His | His | Gln | His | His | Pro | Ser | Pro | Pro | Pro | | | Lys | | | Thr | Gly | Ser | Gly | - | 16 | 415 | 1 | 9 | 10 |
| His | His | Gln | His | His | Pro | Ser | Pro | Pro | Pro | | | Lys | | | Thr | Gly | Ser | Gly | - | 16 | 416 | 2 | 3 | 2 |
| His | His | Gln | His | His | Pro | Ser | Pro | Pro | Pro | | | Lys | | | Thr | Gly | Ser | Gly | - | 16 | 417 | 1 | 1 | 1 |
| His | His | Gln | His | His | Pro | Ser | Pro | Pro | Pro | | | Lys | | | Thr | Gly | Ser | Gly | - | 16 | 418 | 2 | 0 | 2 |
| His | His | Gln | His | His | Pro | Ser | Pro | Pro | Pro | | | Lys | | | Thr | Gly | Ser | Gly | - | 16 | 419 | | | |
| His | His | Gln | His | His | Glu | Ser | Pro | Pro | Pro | Gly | | Lys | | | Thr | | Ser | Gly | - | 16 | 420 | 1 | 10 | 9 |
| His | His | Gln | His | His | Glu | Ser | Pro | Pro | Pro | Gly | | Lys | | | | | Ser | Gly | - | 16 | 421 | | | |
| His | His | Gln | His | His | Glu | Ser | Pro | Pro | Pro | Gly | | Lys | | | | | Asn | His | - | 16 | 422 | 1 | 1 | 2 |
| His | His | Gln | His | His | Glu | Ser | Pro | Pro | Pro | Gly | | Lys | | | | | Asn | His | - | 16 | 423 | 1 | 0 | 3 |
| His | His | Gln | His | His | Glu | Ser | Pro | Pro | Pro | Gly | | Lys | | | | | Asn | His | - | 14 | 424 | | | |
| His | His | Gln | His | His | Glu | Ser | Pro | Pro | Pro | | | Lys | | | | | Asn | His | - | 16 | 425 | | | |
| His | His | Gln | His | His | Glu | Ser | Pro | Pro | Pro | | | Lys | | | Thr | Gly | Ser | Gly | - | 16 | 426 | | | |
| His | His | Gln | His | His | Glu | Ser | Pro | Pro | Pro | | | Lys | | | | Ser | Gly | Thr | - | 18 | 427 | | | |
| His | His | Gln | His | His | Glu | Ser | Pro | Pro | Pro | | | Lys | | | | Ser | Gly | Thr | - | 18 | 428 | | 7 | 7 |
| His | His | Gln | His | His | Glu | Ser | Pro | Pro | Pro | | | Lys | | | | Ser | Gly | Thr | - | 16 | 429 | | | |
| His | His | Gln | His | His | Glu | Ser | Pro | | | | | Lys | | | | Ser | Gly | Thr | - | 14 | 430 | | | |
| His | His | Gln | His | His | Glu | Ser | Pro | Pro | Pro | | | Lys | | | | Ser | Gly | Thr | - | 18 | 431 | | | |
| His | His | Gln | His | His | Glu | Ser | Pro | Pro | Pro | | | Lys | | | | Ser | Gly | Thr | - | 16 | 432 | | | |
| His | His | Gln | His | His | Glu | Ser | Pro | Pro | Pro | | | Lys | | | | Ser | Gly | Thr | - | 14 | 433 | | | |
| His | His | Gln | His | His | Glu | Ser | Pro | Pro | Pro | | | Lys | | | | | Gly | Ser | - | 18 | 434 | 1 | 5 | 4 |
| His | His | Gln | His | His | Glu | Ser | Pro | Pro | Pro | | | Lys | | | | | Gly | Ser | - | 18 | 435 | | | |
| Gly | His | Gln | His | His | His | Thr | Pro | Pro | Pro | | | Lys | | | | | Asn | His | - | 16 | 436 | | | |
| His | His | Gln | His | His | Ala | Ser | Gly | | | | | Lys | | | | | Asn | His | - | 16 | 437 | 1 | 9 | 7 |
| His | His | Gln | His | His | Ala | Ser | Gly | | | | | Lys | | | | | Asn | His | - | 16 | 438 | 2 | 8 | 7 |
| His | His | Gln | His | His | Pro | Ser | Pro | | Pro | Gly | | Lys | | | | | Asn | His | - | 16 | 439 | 1 | 11 | 9 |
| His | His | Gln | His | His | Glu | Ser | Pro | Pro | Pro | | | Lys | | | | | Asn | His | - | 16 | 440 | 1 | 10 | 8 |
| His | His | Gln | His | His | Glu | Ser | Pro | Pro | Pro | | | Lys | | | | | Ser | Gly | - | 16 | 441 | | | 9 |
| His | His | Gln | His | His | Pro | Ser | Pro | Pro | Pro | | | Lys | | | Thr | Gly | Ser | Gly | - | 16 | 442 | | 11 | |
| His | His | Gln | His | His | Pro | Ser | Pro | Pro | Pro | | | Lys | | | Thr | Gly | Ser | Gly | - | 16 | 443 | | | |
| His | His | Gln | His | His | Pro | Ser | Pro | Pro | Pro | | | Lys | | | Thr | Gly | Ser | Gly | - | 16 | 444 | 2 | 9 | |
| His | His | Gln | His | His | Glu | Ser | Pro | Pro | Pro | | | Lys | | | Thr | Gly | Ser | Gly | - | 16 | 445 | | | 7 |

Figure 2 (Continued)

| Ex | G ref | SEQ ID | Note | 1 | 2 | 3 | 4 | 5 | 6 | 7 | 8 | 9 | 10 | 11 | 12 | 13 | 14 | 15 | 16 | 17 | 18 | 19 | 20 | 21 | 22 | 23 | 24 | 25 | 26 | 27 | 28 | 29 |
|---|---|---|---|---|---|---|---|---|---|---|---|---|---|---|---|---|---|---|---|---|---|---|---|---|---|---|---|---|---|---|---|---|
| 446 | 5638 | 446 | | His | AIB | His | Gly | Thr | Phe | Thr | Ser | Asp | Tyr | Ser | Lys | Tyr | Leu | Asp | Glu | Arg | Arg | Ala | Gln | Glu | Phe | Ile | Glu | Trp | Leu | Leu | Gln | Ser |
| 447 | 5639 | 447 | | His | AIB | His | Gly | Thr | Phe | Thr | Ser | Asp | Tyr | Ser | Arg | Tyr | Leu | Asp | Ala | Arg | Arg | Ala | Gln | Glu | Phe | Ile | Glu | Trp | Leu | Leu | Gln | Ser |
| 448 | 5640 | 448 | | His | AIB | His | Gly | Thr | Phe | Thr | Ser | Asp | Tyr | Ser | Arg | Tyr | Leu | Asp | Glu | Arg | Arg | Ala | Gln | Glu | Phe | Ile | Glu | Trp | Leu | Leu | Gln | Ser |
| 449 | 5641 | 449 | | His | AIB | His | Gly | Thr | Phe | Thr | Ser | Asp | Tyr | Ser | Arg | Tyr | Leu | Asp | Ala | Lys | Arg | Ala | Gln | Glu | Phe | Ile | Glu | Trp | Leu | Leu | Gln | Ser |
| 450 | 5642 | 450 | | His | AIB | His | Gly | Thr | Phe | Thr | Ser | Asp | Tyr | Ser | Lys | Tyr | Leu | Asp | Ala | Arg | Arg | Ala | Gln | Glu | Phe | Ile | Glu | Trp | Leu | Leu | Gln | Ser |
| 451 | 5643 | 451 | | His | AIB | His | Gly | Thr | Phe | Thr | Ser | Asp | Tyr | Ser | Lys | Tyr | Leu | Asp | Glu | Arg | Arg | Ala | Gln | Glu | Phe | Ile | Glu | Trp | Leu | Leu | Gln | Ser |
| 452 | 5644 | 452 | | His | AIB | His | Gly | Thr | Phe | Thr | Ser | Asp | Tyr | Ser | Lys | Tyr | Leu | Asp | Glu | Arg | Arg | Ala | His | Glu | Phe | Ile | Glu | Trp | Leu | Leu | His | Gly |
| 453 | 5645 | 453 | | His | AIB | His | Gly | Thr | Phe | Thr | Ser | Asp | Tyr | Ser | Arg | Tyr | Leu | Asp | Ala | Arg | Arg | Ala | His | Glu | Phe | Ile | Glu | Trp | Leu | Leu | His | Gly |
| 454 | 5646 | 454 | | His | AIB | His | Gly | Thr | Phe | Thr | Ser | Asp | Tyr | Ser | Arg | Tyr | Leu | Asp | Glu | Arg | Arg | Ala | Gln | Glu | Phe | Ile | Glu | Trp | Leu | Leu | Gln | Ser |
| 455 | 5647 | 455 | | His | AIB | His | Gly | Thr | Phe | Thr | Ser | Asp | Tyr | Ser | Arg | Tyr | Leu | Asp | Ala | Arg | Arg | Ala | His | Glu | Phe | Ile | Glu | Trp | Leu | Leu | His | Gly |
| 456 | 5648 | 456 | | His | AIB | His | Gly | Thr | Phe | Thr | Ser | Asp | Tyr | Ser | Lys | Tyr | Leu | Asp | Glu | Arg | Arg | Ala | His | Glu | Phe | Ile | Glu | Trp | Leu | Leu | His | Gly |
| 457 | 5649 | 457 | | His | AIB | His | Gly | Thr | Phe | Thr | Ser | Asp | Tyr | Ser | Lys | Tyr | Leu | Asp | Gln | Arg | Arg | Ala | Gln | Glu | Phe | Ile | Glu | Trp | Leu | Leu | Gln | Ser |
| 458 | 5650 | 458 | | His | AIB | His | Gly | Thr | Phe | Thr | Ser | Asp | Tyr | Ser | Arg | Tyr | Leu | Asp | Ala | Lys | Arg | Ala | Gln | Glu | Phe | Ile | Glu | Trp | Leu | Leu | Gln | Ser |
| 459 | 5651 | 459 | Dup Ex158 | His | AIB | His | Gly | Thr | Phe | Thr | Ser | Asp | Tyr | Ser | Arg | Tyr | Leu | Asp | Ala | Arg | Arg | Ala | Gln | Glu | Phe | Ile | Glu | Trp | Leu | Leu | Gln | Ser |
| 460 | 5652 | 460 | | His | AIB | His | Gly | Thr | Phe | Thr | Ser | Asp | Tyr | Ser | Arg | Tyr | Leu | Asp | Gln | Arg | Arg | Ala | Gln | Glu | Phe | Ile | Glu | Trp | Leu | Leu | Gln | Ser |
| 461 | 5653 | 461 | | His | AIB | His | Gly | Thr | Phe | Thr | Ser | Asp | Tyr | Ser | Arg | Tyr | Leu | Asp | Ala | Arg | Arg | Ala | Gly | Glu | Phe | Ile | Glu | Trp | Leu | Leu | Gln | Ser |
| 462 | 5655 | 462 | | His | AIB | Gln | Gly | Thr | Phe | Thr | Ser | Asp | Tyr | Ser | Arg | Tyr | Leu | Asp | Ala | Arg | Arg | Ala | Gln | Glu | Phe | Ile | Glu | Trp | Leu | Leu | Gln | Ser |
| 463 | 5674 | 463 | | His | AIB | His | Gly | Thr | Phe | Thr | Ser | Asp | Tyr | Ser | Arg | Tyr | Leu | Asp | Glu | Arg | Arg | Ala | Gln | Glu | Phe | Ile | Glu | Trp | Leu | Leu | Gln | Ser |
| 464 | 5676 | 464 | | His | AIB | His | Gly | Thr | Phe | Thr | Ser | Asp | Tyr | Ser | Arg | Tyr | Leu | Asp | Ala | Arg | Arg | Ala | Gln | Glu | Phe | Ile | Glu | Trp | Leu | Leu | Gln | Ser |
| 465 | 5677 | 465 | | His | AIB | His | Gly | Thr | Phe | Thr | Ser | Asp | Tyr | Ser | Arg | Tyr | Leu | Glu | Glu | Arg | Arg | Ala | Gln | Glu | Phe | Ile | Glu | Trp | Leu | Leu | Gln | Ser |
| 466 | 5747 | 466 | | His | AIB | His | Gly | Thr | Phe | Thr | Ser | Asp | Tyr | Ser | Lys | Tyr | Leu | Asp | Glu | Arg | Ala | Val | Arg | Leu | Phe | Ile | Glu | Trp | Leu | Leu | Gln | Ser |
| 467 | 5759 | 467 | | His | AIB | His | Gly | Thr | Phe | Thr | Ser | Asp | Tyr | Ser | Arg | Tyr | Leu | Asp | Glu | Arg | Arg | Ala | Gln | Glu | Phe | Ile | Glu | Trp | Leu | Leu | Gln | Ser |
| 468 | 5760 | 468 | | His | AIB | His | Gly | Thr | Phe | Thr | Ser | Asp | Tyr | Ser | Lys | Tyr | Leu | Asp | Glu | Arg | Arg | Ala | Gln | Glu | Phe | Ile | Glu | Trp | Leu | Leu | Gln | Ser |
| 469 | 5761 | 469 | | His | AIB | His | Gly | Thr | Phe | Thr | Ser | Asp | Tyr | Ser | Arg | Tyr | Leu | Asp | Glu | Arg | Arg | Ala | His | Glu | Phe | Ile | Glu | Trp | Leu | Leu | Gln | Ser |
| 470 | 5768 | 470 | | His | AIB | His | Gly | Thr | Phe | Thr | Ser | Asp | Tyr | Ser | Lys | Tyr | Leu | Asp | Glu | Arg | Arg | Ala | His | Glu | Phe | Ile | Glu | Trp | Leu | Leu | Gln | Ser |
| 471 | 5774 | 471 | | His | AIB | His | Gly | Thr | Phe | Thr | Ser | Asp | Tyr | Ser | Arg | Tyr | Leu | Asp | Glu | Arg | Arg | Ala | His | Glu | Phe | Ile | Glu | Trp | Leu | Leu | Gln | Ser |
| 472 | 5778 | 472 | | His | AIB | His | Gly | Thr | Phe | Thr | Ser | Asp | Tyr | Ser | Arg | Tyr | Leu | Asp | Glu | Arg | Arg | Ala | Gln | Glu | Phe | Ile | Glu | Trp | Leu | Leu | Gln | Ser |
| 473 | 5783 | 473 | | His | AIB | His | Gly | Thr | Phe | Thr | Ser | Asp | Tyr | Ser | Arg | Tyr | Leu | Asp | Glu | Arg | Arg | Ala | Gln | Glu | Phe | Ile | Glu | Trp | Leu | Leu | Gln | Ser |
| 474 | 5787 | 474 | | His | AIB | His | Gly | Thr | Phe | Thr | Ser | Asp | Tyr | Ser | Arg | Tyr | Leu | Asp | Glu | Arg | Arg | Ala | Gln | Glu | Phe | Ile | Glu | Trp | Leu | Leu | Gln | Ser |
| 475 | 5788 | 475 | | His | AIB | His | Gly | Thr | Phe | Thr | Ser | Asp | Tyr | Ser | Arg | Tyr | Leu | Asp | Glu | Arg | Arg | Ala | Gln | Glu | Phe | Ile | Glu | Trp | Leu | Leu | Gln | Ser |
| 476 | 5789 | 476 | | His | AIB | His | Gly | Thr | Phe | Thr | Ser | Asp | Tyr | Ser | Arg | Tyr | Leu | Asp | Glu | Arg | Arg | Ala | His | Glu | Phe | Ile | Glu | Trp | Leu | Leu | Gln | Ser |
| 477 | 5790 | 477 | | His | AIB | His | Gly | Thr | Phe | Thr | Ser | Asp | Tyr | Ser | Arg | Tyr | Leu | Asp | Glu | Arg | Arg | Ala | His | Glu | Phe | Ile | Glu | Trp | Leu | Leu | Gln | Ser |
| 478 | 5791 | 478 | | His | AIB | His | Gly | Thr | Phe | Thr | Ser | Asp | Tyr | Ser | Arg | Tyr | Leu | Asp | Glu | Arg | Arg | Ala | Gln | Glu | Phe | Ile | Glu | Trp | Leu | Leu | Gln | Ser |
| 479 | 5792 | 479 | | His | AIB | His | Gly | Thr | Phe | Thr | Ser | Asp | Tyr | Ser | Arg | Tyr | Leu | Asp | Glu | Arg | Arg | Ala | Gln | Glu | Phe | Ile | Glu | Trp | Leu | Leu | Gln | Ser |
| 480 | 5796 | 480 | | His | AIB | His | Gly | Thr | Phe | Thr | Ser | Asp | Tyr | Ser | Lys | Tyr | Leu | Asp | Glu | Arg | Arg | Ala | Gln | Glu | Phe | Ile | Glu | Trp | Leu | Leu | Gln | Ser |
| 481 | 5851 | 481 | | His | AIB | His | Gly | Thr | Phe | Thr | Ser | Asp | Tyr | Ser | Arg | Tyr | Leu | Asp | Glu | Arg | Arg | Ala | Gln | Glu | Phe | Ile | Glu | Trp | Leu | Leu | Gln | Ser |
| 482 | 5852 | 482 | | His | AIB | His | Gly | Thr | Phe | Thr | Ser | Asp | Tyr | Ser | Arg | Tyr | Leu | Asp | Glu | Arg | Arg | Ala | Gln | Glu | Phe | Ile | Glu | Trp | Leu | Leu | Gln | Ser |
| 483 | 5853 | 483 | | His | AIB | His | Gly | Thr | Phe | Thr | Ser | Asp | Tyr | Ser | Arg | Tyr | Leu | Asp | Glu | Arg | Arg | Ala | Gln | Glu | Phe | Ile | Glu | Trp | Leu | Leu | Gln | Ser |
| 484 | 5854 | 484 | | His | AIB | His | Gly | Thr | Phe | Thr | Ser | Asp | Tyr | Ser | Arg | Tyr | Leu | Asp | Glu | Arg | Arg | Ala | Gln | Glu | Phe | Ile | Glu | Trp | Leu | Leu | Gln | Ser |
| 485 | 5878 | 485 | | His | AIB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |

Figure 2 (Continued)

| 30 | 31 | 32 | 33 | 34 | 35 | 36 | 37 | 38 | 39 | 40 | 41 | 42 | 43 | 44 | 45 | 46 | 47 | 48 | Z | n (R=$C_n$) | Ex | n | potent | food |
|---|---|---|---|---|---|---|---|---|---|---|---|---|---|---|---|---|---|---|---|---|---|---|---|---|
| His | His | Gln | His | His | Glu | Ser | Pro | Pro | Pro |  |  |  |  |  | Thr | Gly | Ser | Gly | i | 16 | 446 |  | 8 | 7 |
| His | His | Gln | His | His | Pro | Ser | Pro | Pro | Pro |  |  | Lys |  |  |  |  | Ser | Ser | i | 16 | 447 | 2 |  |  |
| His | His | Gln | His | His | Pro | Ser | Pro | Pro | Pro | Ser |  | Lys |  |  |  |  | Gly | Ser | i | 16 | 448 | 2 | 8 | 7 |
| His | His | Gln | His | His | Glu | Ser | Pro | Pro | Pro |  | Gly | Lys |  |  |  |  | Gly | Ser | i | 16 | 449 |  |  |  |
| His | His | Gln | His | His | Glu | Ser | Pro | Pro | Pro |  |  | Lys |  |  |  |  | Gly | Ser | i | 16 | 450 |  |  |  |
| His | His | Gln | His | His | Glu | Ser | Pro | Pro | Pro |  |  | Lys |  |  |  |  | Gly | Ser | i | 16 | 451 | 2 | 9 | 8 |
| His | His | Gln | His | His | Pro | Ser | Pro | Pro | Pro |  |  | Lys |  |  |  |  | Gly | Ser | i | 16 | 452 | 1 | 4 | 4 |
| His | His | Gln | His | His | Glu | Ser | Pro | Pro | Pro |  |  | Lys |  |  |  |  | Gly | Ser | i | 16 | 453 | 1 | 6 | 5 |
| His | His | Gln | His | His | Glu | Ser | Pro | Pro | Pro |  |  | Lys |  |  |  |  | Gly | Ser | i | 14 | 454 |  |  |  |
| His | His | Gln | His | His | Glu | Ser | Pro | Pro | Pro |  |  | Lys |  |  |  |  | Gly | Ser | i | 14 | 455 | 2 | 6 | 6 |
| His | His | Gln | Gln | His | Pro | Ser | Pro | Pro | Pro |  |  | Lys |  |  |  |  | Gly | Ser | i | 14 | 456 | 1 | 3 | 3 |
| His | His | Gln | His | His | Pro | Ser | Pro | Pro | Pro |  |  | Lys |  |  |  |  | Gly | Ser | i | 14 | 457 | 1 | 4 | 4 |
| His | His | Gln | Gln | His | Pro | Ser | Pro | Pro | Pro |  |  | Lys |  |  |  |  | Gly | Ser | i | 16 | 458 | 1 | 6 | 5 |
| His | His | Gln | Gln | His | Pro | Pro | Pro | Pro | Pro | Gly |  | Lys |  |  |  |  | Gly | Ser | i | 14 | 459 |  |  |  |
| His | His | Gln | Gln | Ser | Pro | Pro | Pro |  |  |  |  | Lys |  |  |  |  | Ser | Gly | i | 18 | 460 | 1 | 5 | 4 |
| His | His | Gln | Gln | Ser | Pro | Pro | Pro |  |  |  |  | Lys |  |  |  |  | Ser | Gly | i | 18 | 461 | 1 | 4 | 2 |
| His | His | Gln | Gln | Ser | Pro | Pro | Pro |  |  |  |  | Lys |  |  |  |  | Ser | Gly | i | 18 | 462 |  |  |  |
| His | His | Gln | His | Ser | Pro | Pro | Pro |  |  |  |  | Lys |  |  |  |  | Gly | Gly | i | 16 | 463 | 1 | 2 | 2.0 |
| His | His | Gln | Gln | Ser | Pro | Pro | Pro |  |  |  |  | Lys |  |  |  |  | Ser | Gly | i | 18 | 464 | 1 | 1.0 | 1.0 |
| His | His | Gln | His | Ser | Pro | Pro | Pro |  |  |  |  | Lys |  |  |  |  | Ser | Gly | i | 18 | 465 | 2 | 4.5 | 4.5 |
| His | His | Gln | His | His | Pro | Pro | Pro | Pro |  |  |  | Lys |  |  |  | Gly | Ser | Gly | i | 16 | 466 | 1 | 2 | 1.0 |
| His | His | Gln | Glu | His | Pro | Pro | Pro |  | Pro |  |  | Lys |  |  |  |  | Gly | Gly | i | 16 | 467 | 1 | 4 | 5.0 |
| His | His | Gln | Glu | Ser | Pro | Pro |  |  |  |  |  | Lys |  |  |  |  | Gly | Ser | i | 16 | 468 | 1 | 4 | 3.0 |
| His | His | Gln | Ser | Pro | Pro | Pro |  |  | Pro |  |  | Lys |  |  |  |  | Gly | Ser | i | 16 | 469 | 1 | 3 | 2.0 |
| His | His | Gln | Ser | Pro | Pro | Pro |  |  |  |  |  | Lys |  |  |  |  | Gly | Ser | i | 16 | 470 | 1 | 3 | 2.0 |
| His | Gln | Glu | His | Ser | Pro | Pro | Pro | Pro | Pro |  |  | Lys |  |  |  |  | Gly | Ser | i | 16 | 471 | 1 | 2 | 1.0 |
| His | Glu | Gln | His | Ser | Pro | Pro |  | Pro | Pro |  |  | Lys |  |  |  |  | Gly | Ser | i | 18 | 472 | 1 | 3 | 2.0 |
| His | Glu | Gln | His | Ser | Pro | Pro |  | Pro | Pro |  |  | Lys |  |  |  |  | Gly | Ser | i | 18 | 473 | 1 | 2 | 1.0 |
| His | Glu | Gln | Glu | Ser | Pro | Pro | Pro | Pro | Pro |  |  | Lys |  |  |  |  | Gly | Ser | i | 16 | 474 | 1 | 3 | 3.0 |
| His | Glu | Gln | Ser | Pro | Pro | Pro | Pro | Pro | Pro |  |  | Lys |  |  |  |  | Gly | Ser | i | 14 | 475 | 1 | 3 | 3.0 |
| His | Glu | Gln | Ser | Pro | Pro | Pro |  |  |  |  |  | Lys |  |  | Thr | Gly | Gly | Gly | i | 16 | 476 | 1 | 1 | 1.0 |
| His | His | Gln | Ser | Pro | Glu | Ser | Pro | Pro | Pro |  |  | Lys |  |  | Thr | Gly | Gly | Ser | i | 16 | 477 | 1 | 3 | 2.0 |
| His | His | Glu | Ser | Pro | Glu | Ser | Pro | Pro | Pro |  |  | Lys |  |  | Thr | Gly | Gly | Ser | i | 14 | 478 | 2 | 5 | 4.0 |
| His | Glu | Gln | Ser | Pro | Glu | Ser | Pro | Pro |  |  |  | Lys |  |  | Thr | Gly | Gly | Ser | i | 14 | 479 | 1 | 4 | 3.0 |
| His | His | Gln | Ser | Pro | Glu | Ser |  |  |  |  |  | Lys |  |  |  |  | Gly | Ser | i | 16 | 480 | 1 | 5 | 5.0 |
| His | His | Gln | Glu | His | Glu | Ser | Pro | Pro | Pro |  |  | Lys |  |  |  |  | Gly | Ser | i | 16 | 481 | 1 | 4 | 4.0 |
| His | His | Gln | Glu | His | Glu | Ser | Pro | Pro | Pro |  |  | Lys |  |  |  |  | Ser | Ser | i | 16 | 482 | 1 | 2 | 2.0 |
| His | His | Gln | Glu | His | Glu | Ser | Pro | Pro | Pro |  |  | Lys |  |  |  |  | Ser | Gly | i | 16 | 483 | 1 | 3 | 3.0 |
| Gln | His | Gln | Ser | His | Glu | Ser | Pro | Pro | Pro | Gly |  | Lys |  |  |  |  | Ser | Gly | i | 16 | 484 | 2 | 4 | 3.5 |
| His | Gln | Gln | His | His | Glu | Ser | Pro | Pro | Pro |  |  | Lys |  |  |  |  | Asn | His | i | 16 | 485 | 1 | 4.0 | 4.0 |

Figure 2 (Continued)

| Ex | G ref | SEQ ID | Note | 1 | 2 | 3 | 4 | 5 | 6 | 7 | 8 | 9 | 10 | 11 | 12 | 13 | 14 | 15 | 16 | 17 | 18 | 19 | 20 | 21 | 22 | 23 | 24 | 25 | 26 | 27 | 28 | 29 |
|---|---|---|---|---|---|---|---|---|---|---|---|---|---|---|---|---|---|---|---|---|---|---|---|---|---|---|---|---|---|---|---|---|
| 486 | 5880 | 486 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 487 | 5888 | 487 | | His | AiB | His | Gly | Thr | Phe | Thr | Ser | Asp | Leu | Ser | Lys | Gln | Leu | Glu | Glu | Glu | Ala | Val | Arg | Leu | Phe | Ile | Glu | Trp | Leu | Lys | Asn | Gly |
| 488 | 5897 | 488 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Lys | Gln | Ser |
| 489 | 5898 | 489 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Lys | Gln | Ser |
| 490 | 5910 | 490 | | His | AiB | His | Gly | Thr | Phe | Thr | Ser | Asp | Tyr | Ser | Arg | Tyr | Leu | Asp | Ala | Lys | Arg | Ala | Gln | Glu | Phe | Ile | Glu | Trp | Leu | Leu | Gln | Ser |
| 491 | 5911 | 491 | | His | AiB | His | Gly | Thr | Phe | Thr | Ser | Asp | Tyr | Ser | Arg | Tyr | Leu | Asp | Ala | Lys | Arg | Ala | Gln | Glu | Phe | Ile | Glu | Trp | Leu | Leu | Gln | Ser |
| 492 | 5912 | 492 | | His | AiB | His | Gly | Thr | Phe | Thr | Ser | Asp | Tyr | Ser | Arg | Tyr | Leu | Asp | Ala | Lys | Arg | Ala | Gln | Glu | Phe | Ile | Glu | Trp | Leu | Leu | Gln | Ser |
| 493 | 5913 | 493 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 494 | 5914 | 494 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 495 | 5915 | 495 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 496 | 5927 | 496 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 497 | 5928 | 497 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 498 | 5929 | 498 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 499 | 5931 | 499 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 500 | 5932 | 500 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 501 | 5933 | 501 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 502 | 5934 | 502 | Dup Ex697 | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 503 | 5936 | 503 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 504 | 5937 | 504 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 505 | 5941 | 505 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | His | Ser |
| 506 | 5942 | 506 | | His | AiB | His | Gly | Thr | Phe | Thr | Ser | Asp | Tyr | Ser | Lys | Tyr | Leu | Asp | Gln | Lys | Arg | Ala | Gln | Glu | Phe | Ile | Glu | Trp | Leu | Leu | Gln | Ser |
| 507 | 5943 | 507 | | His | AiB | His | Gly | Thr | Phe | Thr | Ser | Asp | Tyr | Ser | Lys | Tyr | Leu | Asp | Gln | Lys | Arg | Ala | Gln | Glu | Phe | Ile | Glu | Trp | Leu | Leu | Gln | Ser |
| 508 | 5948 | 508 | | His | AiB | His | Gly | Thr | Phe | Thr | Ser | Asp | Tyr | Ser | Lys | Tyr | Leu | Asp | Gln | Lys | Arg | Ala | Gln | Asp | Phe | Ile | Glu | Trp | Leu | Leu | Gln | Ser |
| 509 | 5949 | 509 | | His | AiB | His | Gly | Thr | Phe | Thr | Ser | Asp | Tyr | Ser | Lys | Tyr | Leu | Asp | Gln | Lys | Arg | Ala | Gln | Asp | Phe | Ile | Glu | Trp | Leu | Leu | His | Ser |
| 510 | 5950 | 510 | | His | AiB | His | Gly | Thr | Phe | Thr | Ser | Asp | Tyr | Ser | Lys | Tyr | Leu | Asp | Glu | Lys | Arg | Ala | Gln | Glu | Phe | Ile | Glu | Trp | Leu | Leu | Gln | Gly |
| 511 | 5958 | 511 | | His | AiB | His | Gly | Thr | Phe | Thr | Ser | Asp | Tyr | Ser | Lys | Tyr | Leu | Asp | Ala | Lys | Arg | Ala | His | Glu | Phe | Ile | Glu | Trp | Leu | Leu | Gln | Ser |
| 512 | 5959 | 512 | | His | AiB | His | Gly | Thr | Phe | Thr | Ser | Asp | Tyr | Ser | Lys | Tyr | Leu | Asp | Ala | Lys | Arg | Ala | His | Glu | Phe | Ile | Glu | Trp | Leu | Leu | His | Ser |
| 513 | 5960 | 513 | | His | AiB | His | Gly | Thr | Phe | Thr | Ser | Asp | Tyr | Ser | Lys | Tyr | Leu | Asp | Ala | Lys | Arg | Ala | His | Glu | Phe | Ile | Glu | Trp | Leu | Leu | Gln | Ser |
| 514 | 5962 | 514 | | His | AiB | His | Gly | Thr | Phe | Thr | Ser | Asp | Tyr | Ser | Lys | Tyr | Leu | Asp | Ala | Lys | Arg | Ala | His | Glu | Phe | Ile | Glu | Trp | Leu | Leu | His | Ser |
| 515 | 5970 | 515 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 516 | 5971 | 516 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | His | Ser |
| 517 | 5972 | 517 | | His | AiB | His | Gly | Thr | Phe | Thr | Ser | Asp | Tyr | Ser | Lys | Tyr | Leu | Asp | Ala | Arg | Arg | Ala | Gln | Glu | Phe | Ile | Glu | Trp | Leu | Leu | Gln | Ser |
| 518 | 5973 | 518 | | His | AiB | His | Gly | Thr | Phe | Thr | Ser | Asp | Tyr | Ser | Lys | Tyr | Leu | Asp | Ala | Arg | Arg | Ala | Gln | Glu | Phe | Ile | Glu | Trp | Leu | Leu | His | Ser |
| 519 | 5974 | 519 | | His | AiB | His | Gly | Thr | Phe | Thr | Ser | Asp | Tyr | Ser | Lys | Tyr | Leu | Asp | Ala | Arg | Arg | Ala | Gln | Glu | Phe | Ile | Glu | Trp | Leu | Leu | Gln | Ser |
| 520 | 5975 | 520 | | His | AiB | His | Gly | Thr | Phe | Thr | Ser | Asp | Tyr | Ser | Lys | Tyr | Leu | Asp | Ala | Arg | Arg | Ala | Gln | Glu | Phe | Ile | Glu | Trp | Leu | Leu | His | Ser |
| 521 | 5976 | 521 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 522 | 5987 | 522 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | His | Ser |
| 523 | 5988 | 523 | | His | AiB | His | Gly | Thr | Phe | Thr | Ser | Asp | Tyr | Ser | Lys | Tyr | Leu | Asp | Glu | Arg | Arg | Ala | Gln | Glu | Phe | Ile | Glu | Trp | Leu | Leu | Gln | Ser |
| 524 | 5993 | 524 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | His | Ser |
| 525 | 5996 | 525 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | His | Ser |

Figure 2 (Continued)

| 30 | 31 | 32 | 33 | 34 | 35 | 36 | 37 | 38 | 39 | 40 | 41 | 42 | 43 | 44 | 45 | 46 | 47 | 48 | Z | n (R=C$_n$) | Ex | n | potent | food |
|---|---|---|---|---|---|---|---|---|---|---|---|---|---|---|---|---|---|---|---|---|---|---|---|---|
| His | Gln | His | Glu | Ser | Pro | Pro | Pro | Gly | | | | | | | | | Asn | His | i | 16 | 486 | 1 | 4.0 | 4.0 |
| His | His | Gln | His | His | Pro | Ser | Pro | Pro | Pro | | | | | | | | Asn | His | i | 16 | 487 | 1 | 2 | 0.0 |
| His | His | Gln | His | His | Pro | Ser | Pro | Pro | Pro | | | | | | | | Gly | Ser | i | 16 | 488 | 1 | 5 | 4.0 |
| His | His | Gln | His | His | Pro | Ser | Pro | Pro | Pro | | | | | | | | | Asn | i | 16 | 489 | 1 | 3 | 2.0 |
| His | Gln | Glu | Ser | Pro | Pro | Pro | Gly | | | | | Lys | | | | | Ser | Gly | i | 16 | 490 | 1 | 6.0 | 6.0 |
| His | Gln | Glu | Ser | Pro | Pro | Gly | Pro | | | | | Lys | | | | | Ser | Gly | i | 16 | 491 | 2 | 4.5 | 4.0 |
| His | His | Gln | His | Ser | Pro | Pro | Pro | | | | | Lys | | | | | | Asn | i | 16 | 492 | 2 | 4.0 | 4.0 |
| His | Gln | His | Pro | Ser | Pro | Pro | Pro | | | | | Lys | | | | | | Asn | i | 16 | 493 | 2 | 4.0 | 4.0 |
| Gln | Gln | His | Pro | Ser | Pro | Pro | Pro | | | | | Lys | | | | | | Asn | i | 16 | 494 | 2 | 3.0 | 2.5 |
| Gln | Gln | Gln | Glu | Ser | Pro | Pro | Pro | | | | | Lys | | | | | | Asn | i | 16 | 495 | 2 | 4.0 | 4.0 |
| His | Gln | His | Pro | Ser | Pro | Pro | Pro | | | | | Lys | | | | | Asn | His | i | 16 | 496 | 1 | 5.0 | 5.0 |
| His | Gln | His | Pro | Ser | Pro | Pro | Pro | | | | | Lys | | | | | Gly | Ser | i | 16 | 497 | 2 | 4.0 | 4.0 |
| His | Gln | His | Pro | Ser | Pro | Pro | Pro | | | | | Lys | | | | | | Asn | i | 16 | 498 | 2 | 3.8 | 3.8 |
| His | Gln | His | Ser | Ser | Pro | Pro | Pro | Gly | | | | Lys | | | | | | Asn | i | 18 | 499 | 1 | 4.0 | 4.0 |
| His | Gln | His | Ser | Ser | Pro | Pro | Pro | Gly | | | | Lys | | | | | | Asn | i | 18 | 500 | 1 | 2.0 | 3.0 |
| Gln | Gln | Gln | Pro | Ser | Pro | Pro | Pro | Gly | | | | Lys | | | | | | Asn | i | 18 | 501 | 1 | 5.0 | 5.0 |
| His | Gln | His | Pro | Ser | Pro | Pro | Pro | | | | | Lys | | Thr | Gly | Ser | Gly | i | 16 | 502 | 3 | 4.0 | 4.3 |
| His | Gln | His | Ser | Ser | Pro | Pro | Pro | Gly | | | | Lys | | | | | Asn | i | 18 | 503 | 1 | 5.0 | 5.0 |
| His | Gln | His | Ser | Ser | Pro | Pro | Pro | Gly | | | | Lys | | | | | Asn | i | 18 | 504 | 1 | 4.0 | 4.0 |
| His | Gln | His | Gly | Pro | Pro | Pro | | | | | | Lys | | Gly | Ser | Gly | Ser | Gly | i | 16 | 505 | 1 | 2.0 | 2.0 |
| His | Gln | His | Ala | Pro | Pro | Pro | | | | | | Lys | | Gly | Ser | Gly | Ser | Gly | i | 16 | 506 | 2 | 3.5 | 3.5 |
| His | Gln | His | Ala | Pro | Pro | Pro | | | | | | Lys | | Gly | Ser | Gly | Ser | Gly | i | 16 | 507 | 8 | 5.9 | 5.3 |
| His | Gln | Gly | Ala | Pro | Pro | Pro | | | | | | Lys | | Gly | Ser | Thr | Gly | Ser | i | 14 | 508 | 1 | 2.0 | 2.0 |
| His | Gln | His | Ser | Pro | Pro | Pro | Pro | | | | | Lys | | | | | Asn | His | i | 16 | 509 | 1 | 2 | 2.0 |
| His | Gln | His | Glu | Ser | Pro | Pro | Pro | | | | | Lys | | | | | Asn | His | i | 16 | 510 | 1 | 3 | 3.0 |
| His | Gln | His | Pro | Ala | Pro | Pro | | | | | | Lys | | | | Gly | Ser | Gly | i | 16 | 511 | 1 | 2 | 2.0 |
| His | Gln | His | Pro | Gly | Pro | Pro | | | | | | Lys | | | | Gly | Ser | Gly | i | 16 | 512 | 1 | 2 | 2.0 |
| Pro | Gln | His | Ser | Ser | Pro | Pro | Pro | | | | | Lys | | | | Gly | Ser | Gly | i | 16 | 513 | 1 | 2 | 2.0 |
| His | Gln | His | Pro | Ser | Pro | Pro | Pro | Gly | Pro | | | Lys | | Thr | Gly | Ser | Gly | i | 16 | 514 | 2 | 6.5 | 6.0 |
| His | Gln | His | Pro | Ser | Ser | Pro | Pro | Gly | Gly | | | Lys | | | | Asn | His | i | 16 | 515 | 1 | 4.0 | 4.0 |
| His | Gln | His | Pro | Ser | Pro | Pro | Pro | Gly | Pro | | | Lys | | | | Asn | His | i | 16 | 516 | 1 | 4.0 | 4.0 |
| His | Pro | His | Pro | Ser | Pro | Pro | | Pro | | | | Lys | | | | Gly | Ser | i | 16 | 517 | 1 | 4.0 | 4.0 |
| His | Gln | His | Pro | Ser | Pro | Pro | Pro | Gly | | | | Lys | | | | Gly | Ser | i | 16 | 518 | 1 | 4.0 | 4.0 |
| His | Gln | His | Pro | Ser | Pro | Pro | Pro | | Pro | | | Lys | | | | | Asn | i | 16 | 519 | 1 | 4.0 | 4.0 |
| His | Gln | His | Pro | Ser | Pro | Pro | Pro | Gly | | | | Lys | | | | | Asn | i | 16 | 520 | 1 | 4.0 | 4.0 |
| His | Pro | His | Gln | Pro | Ser | Pro | Pro | Pro | | | | Lys | | | | | Asn | i | 18 | 521 | 1 | 4.0 | 4.0 |
| Gln | His | Gln | His | Gln | Glu | Ser | Pro | Pro | Pro | | | Lys | | Thr | Gly | Ser | Gly | i | 16 | 522 | 1 | 1.0 | 1.0 |
| His | His | Gln | His | Gln | Pro | Ser | Pro | Pro | Pro | | | Lys | | Thr | Gly | Ser | Gly | i | 16 | 523 | 1 | 1.0 | 1.0 |
| His | His | Gln | His | Pro | Pro | Pro | Pro | Pro | Pro | | | Lys | | Thr | Gly | Ser | Gly | i | 16 | 524 | 1 | 1 | 1.0 |
| His | Gln | Gln | His | His | Pro | Ser | Pro | Pro | Pro | | | Lys | | Thr | Gly | Ser | Gly | i | 16 | 525 | 1 | 1.0 | 1.0 |

Figure 2 (Continued)

| Ex | G ref | SEQ ID | Note | 1 | 2 | 3 | 4 | 5 | 6 | 7 | 8 | 9 | 10 | 11 | 12 | 13 | 14 | 15 | 16 | 17 | 18 | 19 | 20 | 21 | 22 | 23 | 24 | 25 | 26 | 27 | 28 | 29 |
|---|---|---|---|---|---|---|---|---|---|---|---|---|---|---|---|---|---|---|---|---|---|---|---|---|---|---|---|---|---|---|---|---|
| 526 | 6002 | 526 | | His | AiB | His | Gly | Thr | Phe | Thr | Ser | Asp | Tyr | Ser | Lys | Tyr | Leu | Asp | Glu | Arg | Arg | Ala | Gln | Glu | Phe | Ile | Glu | Trp | Leu | Leu | Gln | Ser |
| 527 | 6013 | 527 | | His | AiB | His | Gly | Thr | Phe | Thr | Ser | Asp | Leu | Ser | Lys | Gln | Leu | Glu | Glu | Lys | Arg | Ala | Gln | Glu | Phe | Ile | Glu | Trp | Leu | Leu | Asn | Gly |
| 528 | 6014 | 528 | | His | AiB | His | Gly | Thr | Phe | Thr | Ser | Asp | Leu | Ser | Lys | Gln | Leu | Glu | Glu | Lys | Arg | Ala | His | Glu | Phe | Ile | Glu | Trp | Leu | Leu | His | Gly |
| 529 | 6015 | 529 | | His | AiB | His | Gly | Thr | Phe | Thr | Ser | Asp | Leu | Ser | Lys | Gln | Leu | Glu | Ala | Lys | Arg | Ala | His | Glu | Phe | Ile | Glu | Trp | Leu | Leu | His | Gly |
| 530 | 6016 | 530 | | His | AiB | His | Gly | Thr | Phe | Thr | Ser | Asp | Leu | Ser | Lys | Gln | Leu | Glu | Ala | Lys | Arg | Ala | His | Glu | Phe | Ile | Glu | Trp | Leu | Leu | His | Ser |
| 531 | 6021 | 531 | | His | AiB | His | Gly | Thr | Phe | Thr | Ser | Asp | Leu | Ser | Lys | Gln | Leu | Glu | Ala | Glu | Ala | Val | Arg | Leu | Phe | Ile | Glu | Trp | Leu | Leu | Gln | Gly |
| 532 | 6045 | 532 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 533 | 6046 | 533 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 534 | 6047 | 534 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 535 | 6048 | 535 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 536 | 6049 | 536 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 537 | 6050 | 537 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 538 | 6051 | 538 | | His | AiB | His | Gly | Thr | Phe | Thr | Ser | Asp | Tyr | Ser | Lys | Tyr | Leu | Asp | Glu | Lys | Arg | Ala | Gln | Glu | Phe | Ile | Glu | Trp | Leu | Leu | Gln | Ser |
| 539 | 6064 | 539 | | His | AiB | His | Gly | Thr | Phe | Thr | Ser | Asp | Leu | Ser | Lys | Gln | Leu | Glu | Glu | Lys | Arg | Ala | Gln | Glu | Phe | Ile | Glu | Trp | Leu | Leu | Asn | Gly |
| 540 | 6065 | 540 | | His | AiB | His | Gly | Thr | Phe | Thr | Ser | Asp | Leu | Ser | Lys | Gln | Leu | Glu | Glu | Glu | Arg | Val | Arg | Glu | Phe | Ile | Glu | Trp | Leu | Leu | Asn | Gly |
| 541 | 6066 | 541 | | His | AiB | His | Gly | Thr | Phe | Thr | Ser | Asp | Leu | Ser | Lys | Gln | Leu | Glu | Glu | Glu | Arg | Val | Arg | Glu | Phe | Ile | Glu | Trp | Leu | Lys | Asn | Gly |
| 542 | 6067 | 542 | | His | AiB | His | Gly | Thr | Phe | Thr | Ser | Asp | Tyr | Ser | Lys | Tyr | Leu | Glu | Ala | Lys | Arg | Ala | Gln | Glu | Phe | Ile | Glu | Trp | Leu | Leu | Gln | Ser |
| 543 | 6069 | 543 | | His | AiB | His | Gly | Thr | Phe | Thr | Ser | Asp | Tyr | Ser | Lys | Tyr | Leu | Glu | Ala | Lys | Arg | Ala | Gln | Glu | Phe | Ile | Glu | Trp | Leu | Leu | Gln | Ser |
| 544 | 6070 | 544 | | His | AiB | His | Gly | Thr | Phe | Thr | Ser | Asp | Tyr | Ser | Arg | Tyr | Leu | Glu | Glu | Arg | Arg | Ala | Gln | Glu | Phe | Ile | Glu | Trp | Leu | Leu | Gln | Ser |
| 545 | 6072 | 545 | | His | AiB | His | Gly | Thr | Phe | Thr | Ser | Asp | Tyr | Ser | Arg | Tyr | Leu | Glu | Glu | Arg | Arg | Ala | Gln | Glu | Phe | Ile | Glu | Trp | Leu | Leu | Gln | Ser |
| 546 | 6074 | 546 | | His | AiB | His | Gly | Thr | Phe | Thr | Ser | Asp | Tyr | Ser | Lys | Tyr | Leu | Glu | Glu | Arg | Arg | Ala | Gln | Glu | Phe | Ile | Glu | Trp | Leu | Leu | Gln | Ser |
| 547 | 6075 | 547 | | His | AiB | His | Gly | Thr | Phe | Thr | Ser | Asp | Tyr | Ser | Lys | Tyr | Leu | Glu | Glu | Lys | Arg | Ala | Gln | Glu | Phe | Ile | Glu | Trp | Leu | Leu | His | Ser |
| 548 | 6076 | 548 | | His | AiB | His | Gly | Thr | Phe | Thr | Ser | Asp | Tyr | Ser | Lys | Tyr | Leu | Glu | Glu | Lys | Arg | Ala | Gln | Glu | Phe | Ile | Glu | Trp | Leu | Leu | Gln | Ser |
| 549 | 6077 | 549 | | His | AiB | His | Gly | Thr | Phe | Thr | Ser | Asp | Leu | Ser | Lys | Gln | Leu | Glu | Glu | Glu | Arg | Ala | Gln | Glu | Phe | Ile | Glu | Trp | Leu | Leu | Gln | Ser |
| 550 | 6078 | 550 | | His | AiB | His | Gly | Thr | Phe | Thr | Ser | Asp | Leu | Ser | Lys | Gln | Leu | Glu | Glu | Glu | Arg | Ala | Gln | Leu | Phe | Ile | Glu | Trp | Leu | Leu | Gln | Ser |
| 551 | 6079 | 551 | | His | AiB | His | Gly | Thr | Phe | Thr | Ser | Asp | Leu | Ser | Lys | Gln | Leu | Glu | Glu | Glu | Arg | Val | Arg | Leu | Phe | Ile | Glu | Trp | Leu | Lys | His | Ser |
| 552 | 6080 | 552 | | His | AiB | His | Gly | Thr | Phe | Thr | Ser | Asp | Leu | Ser | Lys | Gln | Leu | Glu | Glu | Glu | Arg | Val | Arg | Leu | Phe | Ile | Glu | Trp | Leu | Lys | His | Ser |
| 553 | 6081 | 553 | | His | AiB | His | Gly | Thr | Phe | Thr | Ser | Asp | Leu | Ser | Lys | Gln | Leu | Glu | Glu | Glu | Arg | Val | Arg | Leu | Phe | Ile | Glu | Trp | Leu | Lys | His | Ser |
| 554 | 6085 | 554 | | His | AiB | His | Gly | Thr | Phe | Thr | Ser | Asp | Leu | Ser | Lys | Gln | Leu | Glu | Glu | Glu | Arg | Val | Arg | Leu | Phe | Ile | Glu | Trp | Leu | Lys | Asn | Gly |
| 555 | 6086 | 555 | | His | AiB | His | Gly | Thr | Phe | Thr | Ser | Asp | Leu | Ser | Lys | Gln | Leu | Glu | Glu | Glu | Arg | Val | Arg | Leu | Phe | Ile | Glu | Trp | Leu | Lys | Asn | Gly |
| 556 | 6087 | 556 | | His | AiB | His | Gly | Thr | Phe | Thr | Ser | Asp | Leu | Ser | Lys | Gln | Leu | Glu | Glu | Glu | Arg | Val | Arg | Leu | Phe | Ile | Glu | Trp | Leu | Lys | Asn | Gly |
| 557 | 6089 | 557 | | His | AiB | His | Gly | Thr | Phe | Thr | Ser | Asp | Leu | Ser | Lys | Gln | Leu | Glu | Glu | Glu | Arg | Val | Arg | Leu | Phe | Ile | Glu | Trp | Leu | Lys | Asn | Gly |
| 558 | 6094 | 558 | | His | AiB | His | Gly | Thr | Phe | Thr | Ser | Asp | Leu | Ser | Lys | Gln | Leu | Glu | Glu | Glu | Arg | Val | Arg | Leu | Phe | Ile | Glu | Trp | Leu | Lys | Asn | Gly |
| 559 | 6096 | 559 | | His | AiB | His | Gly | Thr | Phe | Thr | Ser | Asp | Leu | Ser | Lys | Gln | Leu | Glu | Glu | Glu | Arg | Val | Arg | Leu | Phe | Ile | Glu | Trp | Leu | Lys | Asn | Gly |
| 560 | 6097 | 560 | | His | AiB | His | Gly | Thr | Phe | Thr | Ser | Asp | Leu | Ser | Lys | Gln | Leu | Glu | Glu | Glu | Arg | Val | Arg | Leu | Phe | Ile | Glu | Trp | Leu | Lys | Asn | Gly |
| 561 | 6098 | 561 | | His | AiB | His | Gly | Thr | Phe | Thr | Ser | Asp | Leu | Ser | Lys | Gln | Leu | Glu | Glu | Glu | Arg | Val | Arg | Leu | Phe | Ile | Glu | Trp | Leu | Lys | Asn | Gly |
| 562 | 6099 | 562 | | His | AiB | His | Gly | Thr | Phe | Thr | Ser | Asp | Leu | Ser | Lys | Gln | Leu | Glu | Glu | Glu | Arg | Val | Arg | Leu | Phe | Ile | Glu | Trp | Leu | Lys | Asn | Gly |
| 563 | 6100 | 563 | | His | AiB | His | Gly | Thr | Phe | Thr | Ser | Asp | Leu | Ser | Lys | Gln | Leu | Glu | Glu | Glu | Arg | Val | Arg | Leu | Phe | Ile | Glu | Trp | Leu | Lys | Asn | Gly |
| 564 | 6102 | 564 | | His | AiB | His | Gly | Thr | Phe | Thr | Ser | Asp | Leu | Ser | Lys | Gln | Leu | Glu | Glu | Glu | Arg | Val | Arg | Leu | Phe | Ile | Glu | Trp | Leu | Lys | Asn | Gly |
| 565 | 6103 | 565 | | His | AiB | His | Gly | Thr | Phe | Thr | Ser | Asp | Leu | Ser | Lys | Gln | Leu | Glu | Glu | Glu | Arg | Val | Arg | Leu | Phe | Ile | Glu | Trp | Leu | Lys | Asn | Gly |

Figure 2 (Continued)

| 30 | 31 | 32 | 33 | 34 | 35 | 36 | 37 | 38 | 39 | 40 | 41 | 42 | 43 | 44 | 45 | 46 | 47 | 48 | Z | n (R=C$_n$) | Ex | n | potent | food |
|---|---|---|---|---|---|---|---|---|---|---|---|---|---|---|---|---|---|---|---|---|---|---|---|---|
| His | His | Gln | Gln | His | Pro | Ser | Pro | Pro | Pro | | | | | | Thr | Gly | Ser | Gly | - | 16 | 526 | | | |
| His | Pro | Ser | Ser | Gly | Ala | Pro | Pro | Pro | | | | | | | Gly | Ser | Gly | Ser | - | 16 | 527 | | | |
| His | Pro | Ser | Ser | Gly | Ala | Pro | Pro | Pro | | | | Lys | | | Gly | Ser | Gly | Ser | - | 16 | 528 | | | |
| His | Pro | Ser | Ser | Gly | Ala | Pro | Pro | Pro | | | | Lys | | | Gly | Ser | Gly | Ser | - | 16 | 529 | | | |
| His | Pro | Ser | Ser | Gly | Ala | Pro | Pro | Pro | | | | Lys | | | | | Asn | His | - | 16 | 530 | | | |
| His | Pro | Ser | Ser | Gly | Ala | Pro | Pro | Pro | | | | Lys | | | | | Asn | His | - | 16 | 531 | | | |
| His | Gln | Gln | Ser | His | Pro | Ser | Pro | Pro | Pro | | | Lys | | | Thr | Gly | Ser | Gly | - | 16 | 532 | 2 | 5.8 | 6.0 |
| His | Gln | Gln | His | His | Pro | Ser | Pro | Pro | Pro | | | Lys | | | Thr | Gly | Ser | Gly | - | 16 | 533 | 2 | 4.5 | 5.0 |
| His | Gln | Gln | Gln | His | Pro | Ser | Pro | Pro | Pro | | | Lys | | | Thr | Gly | Ser | Gly | - | 16 | 534 | 1 | 5.0 | 5.0 |
| His | Gln | Gln | Gln | His | Pro | Ser | Pro | Pro | Pro | | | Lys | | | Thr | Gly | Ser | Gly | - | 16 | 535 | 3 | 5.3 | 5.0 |
| His | Gln | His | His | His | Pro | Ser | Pro | Pro | Pro | | | Lys | | | | | | Asn | - | 16 | 536 | 2 | 6 | 6.0 |
| His | Gln | His | His | His | Pro | Ser | Pro | Pro | Pro | | | Lys | | | | | | | - | 18 | 537 | 2 | 5 | 4.0 |
| His | Gln | His | His | His | Pro | Ser | Pro | Pro | Pro | | | Lys | | | | | | | - | 18 | 538 | 2 | 6 | 6.0 |
| Gly | Pro | His | Ser | Gly | Ala | Pro | Pro | Pro | Gly | Gly | | Lys | | | | | | | - | 18 | 539 | 1 | 1 | 0.0 |
| His | Pro | His | His | Gly | Ala | Pro | Pro | Pro | Gly | | | Lys | | | | | | | - | 18 | 540 | 1 | 1 | 0.0 |
| Gly | Pro | His | His | Gly | Ala | Pro | Pro | Pro | Gly | | | Lys | | | | | | | - | 18 | 541 | 1 | 3 | 0.0 |
| Gln | Gln | His | Glu | Ser | Pro | Pro | Pro | Pro | | | | Lys | | | | | | | - | 18 | 542 | 5 | 5.5 | 5.5 |
| Gln | Gln | His | Glu | Ser | Pro | Pro | Pro | Pro | | | | Lys | | | | | | | - | 18 | 543 | 5 | 6.4 | 6.4 |
| Gln | Gln | Gln | Pro | Ser | Pro | Pro | Gly | Pro | | | | Lys | | | | | | | - | 18 | 544 | 3 | 6.2 | 6.0 |
| Gln | Gln | Glu | Ser | Ser | Pro | Pro | Pro | Pro | | | | Lys | | | | | | | - | 18 | 545 | 3 | 5.5 | 5.5 |
| Gln | Gln | Glu | Glu | Ser | Glu | Ser | Pro | Gly | Pro | Gly | | Lys | | | | | | | - | 18 | 546 | 1 | 6.0 | 4.0 |
| Gln | Gln | His | Gln | Gln | Pro | Ser | Pro | Gly | Pro | | | Lys | | | | | | | - | 18 | 547 | 1 | 3.0 | 4.0 |
| His | Gln | His | Pro | Ser | Pro | Ser | Pro | Pro | Pro | | | Lys | | | | | | Asn | - | 18 | 548 | 1 | 5.5 | 6.0 |
| His | His | Gln | Ser | Ser | Pro | Ser | Pro | Pro | Pro | | | Lys | | | | | | | - | 18 | 549 | 5 | 5.4 | 5.7 |
| His | His | Gln | His | Ser | Pro | Pro | Pro | Pro | Gly | | | Lys | | | | | | | - | 18 | 550 | 5 | 5.4 | 5.7 |
| His | His | Ser | Pro | Ser | Ala | Pro | Pro | Pro | Gly | | | Lys | | | | | | | - | 18 | 551 | 4 | 4.6 | 4.9 |
| His | His | His | Ser | Gly | Ala | Pro | Pro | Pro | Gly | | | Lys | | | | | | | - | 18 | 552 | 4 | 5.8 | 5.6 |
| His | Pro | His | His | Gly | His | Pro | Pro | Pro | Gly | | | Lys | | | | | | | - | 18 | 553 | 5 | 5.4 | 5.3 |
| Gly | Pro | His | His | Gly | Ala | Pro | Pro | Pro | Gly | | | Lys | | | | | | | - | 18 | 554 | | | |
| Gly | Pro | His | Ser | Gly | Ala | Pro | Pro | Pro | Gly | | | Lys | | | | | | | - | 18 | 555 | | | |
| Gly | Pro | Ser | His | Gly | His | Pro | Pro | Pro | Gly | | | Lys | | | | | | | - | 18 | 556 | 1 | 10 | 0.0 |
| His | Pro | His | His | Gly | Ala | Pro | Pro | Pro | Gly | | | Lys | | | | | | | - | 18 | 557 | 1 | 14 | 0.0 |
| His | Pro | Ser | His | Gly | Ala | Pro | Pro | Pro | Gly | | | Lys | | | | | | | - | 18 | 558 | 1 | 15 | 0.0 |
| His | Pro | Ser | His | Gly | His | Pro | Pro | Pro | Gly | | | Lys | | | | | | | - | 18 | 559 | 1 | 5 | 0.0 |
| His | Gly | Ser | Ser | Gly | Ala | Pro | Pro | Pro | Gly | | | Lys | | | | | | | - | 18 | 560 | | | |
| His | His | Pro | His | Gly | Ala | Pro | Pro | Pro | Gly | | | Lys | | | | | | | - | 18 | 561 | | | |
| Gly | Gln | His | His | Gly | Ala | Pro | Pro | Pro | Gly | | | Lys | | | | | | | - | 18 | 562 | | | |
| Gly | Pro | Ser | His | Gly | Ala | Pro | Pro | Pro | Gly | | | Lys | | | | | | | - | 18 | 563 | | | |
| Gly | His | His | His | Gly | Ala | Pro | Pro | Pro | Gly | | | Lys | | | | | Asn | Asn | - | 18 | 564 | 1 | 4 | 0.0 |
| Gly | Ser | Ser | Ser | Gly | Ala | Pro | Pro | Pro | Gly | | | Lys | | | | | Asn | Asn | - | 18 | 565 | | | |

Figure 2 (Continued)

| Ex | G ref | SEQ ID | Note | 1 | 2 | 3 | 4 | 5 | 6 | 7 | 8 | 9 | 10 | 11 | 12 | 13 | 14 | 15 | 16 | 17 | 18 | 19 | 20 | 21 | 22 | 23 | 24 | 25 | 26 | 27 | 28 | 29 |
|---|---|---|---|---|---|---|---|---|---|---|---|---|---|---|---|---|---|---|---|---|---|---|---|---|---|---|---|---|---|---|---|---|
| 566 | 6104 | 566 | | His | AiB | His | Gly | Thr | Phe | Thr | Ser | Asp | Leu | Ser | Lys | Gln | Leu | Glu | Glu | Glu | Arg | Val | Arg | Leu | Phe | Ile | Glu | Trp | Leu | Lys | Asn | Gly |
| 567 | 6105 | 567 | | His | AiB | His | Gly | Thr | Phe | Thr | Ser | Asp | Leu | Ser | Lys | Gln | Leu | Glu | Glu | Glu | Arg | Val | Arg | Leu | Phe | Ile | Glu | Trp | Leu | Lys | Asn | Gly |
| 568 | 6106 | 568 | | His | AiB | His | Gly | Thr | Phe | Thr | Ser | Asp | Leu | Ser | Lys | Gln | Leu | Glu | Glu | Glu | Arg | Val | Arg | Leu | Phe | Ile | Glu | Trp | Leu | Lys | Asn | Gly |
| 569 | 6107 | 569 | | His | AiB | His | Gly | Thr | Phe | Thr | Ser | Asp | Leu | Ser | Lys | Gln | Leu | Glu | Glu | Glu | Arg | Val | Arg | Leu | Phe | Ile | Glu | Trp | Leu | Lys | Asn | Gly |
| 570 | 6108 | 570 | | His | AiB | His | Gly | Thr | Phe | Thr | Ser | Asp | Leu | Ser | Lys | Gln | Leu | Glu | Glu | Glu | Arg | Val | His | Leu | Phe | Ile | Glu | Trp | Leu | Lys | Asn | Gly |
| 571 | 6109 | 571 | | His | AiB | His | Gly | Thr | Phe | Thr | Ser | Asp | Leu | Ser | Lys | Gln | Leu | Glu | Glu | Glu | Arg | Val | Arg | Leu | Phe | Ile | Glu | Trp | Leu | Lys | Asn | Gly |
| 572 | 6110 | 572 | | His | AiB | His | Gly | Thr | Phe | Thr | Ser | Asp | Leu | Ser | Lys | Gln | Leu | Glu | Glu | Glu | Ala | Val | Arg | Leu | Phe | Ile | Glu | Trp | Leu | Lys | Asn | Gly |
| 573 | 6111 | 573 | | His | AiB | His | Gly | Thr | Phe | Thr | Ser | Asp | Leu | Ser | Lys | Gln | Leu | Glu | Gln | Glu | Ala | Val | Arg | Leu | Phe | Ile | Glu | Trp | Leu | Lys | Asn | Gly |
| 574 | 6112 | 574 | | His | AiB | His | Gly | Thr | Phe | Thr | Ser | Asp | Leu | Ser | Lys | Gln | Leu | Glu | Gln | Glu | Ala | Val | Arg | Leu | Phe | Ile | Glu | Trp | Leu | Lys | Asn | Gly |
| 575 | 6113 | 575 | | His | AiB | His | Gly | Thr | Phe | Thr | Ser | Asp | Leu | Ser | Lys | Gln | Leu | Glu | Gln | Glu | Ala | Val | Arg | Leu | Phe | Ile | Glu | Trp | Leu | Lys | Asn | Gly |
| 576 | 6114 | 576 | | His | AiB | His | Gly | Thr | Phe | Thr | Ser | Asp | Leu | Ser | Lys | Gln | Leu | Glu | Gln | Glu | Ala | Val | Arg | Leu | Phe | Ile | Glu | Trp | Leu | Lys | Asn | Gly |
| 577 | 6115 | 577 | | His | AiB | His | Gly | Thr | Phe | Thr | Ser | Asp | Leu | Ser | Lys | Gln | Leu | Glu | Gln | Glu | Ala | Val | Arg | Leu | Phe | Ile | Glu | Trp | Leu | Lys | Asn | Gly |
| 578 | 6116 | 578 | | His | AiB | His | Gly | Thr | Phe | Thr | Ser | Asp | Leu | Ser | Lys | Gln | Leu | Glu | Gln | Glu | Ala | Val | Arg | Leu | Phe | Ile | Glu | Trp | Leu | Lys | Asn | Gly |
| 579 | 6117 | 579 | | His | AiB | His | Gly | Thr | Phe | Thr | Ser | Asp | Leu | Ser | Lys | Gln | Leu | Glu | Gln | Glu | Ala | Val | Arg | Leu | Phe | Ile | Glu | Trp | Leu | Lys | Asn | Gly |
| 580 | 6118 | 580 | | His | AiB | His | Gly | Thr | Phe | Thr | Ser | Asp | Leu | Ser | Lys | Gln | Leu | Glu | Gln | Glu | Ala | Val | Arg | Leu | Phe | Ile | Glu | Trp | Leu | Lys | Asn | Gly |
| 581 | 6120 | 581 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 582 | 6121 | 582 | | His | AiB | His | Gly | Thr | Phe | Thr | Ser | Asp | Tyr | Ser | Arg | Tyr | Leu | Asp | Ala | Lys | Arg | Ala | Gln | Glu | Phe | Ile | Glu | Trp | Leu | Leu | Gln | Ser |
| 583 | 6124 | 583 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 584 | 6125 | 584 | | His | AiB | His | Gly | Thr | Phe | Thr | Ser | Asp | Tyr | Ser | Lys | Tyr | Leu | Glu | Ala | Lys | Ala | Ala | Gln | Glu | Phe | Ile | Glu | Trp | Leu | Leu | Gln | Ser |
| 585 | 6127 | 585 | | His | AiB | His | Gly | Thr | Phe | Thr | Ser | Asp | Leu | Ser | Lys | Gln | Leu | Glu | Glu | Glu | Ala | Val | Arg | Leu | Phe | Ile | Glu | Trp | Leu | Lys | Asn | Gly |
| 586 | 6128 | 586 | | His | AiB | His | Gly | Thr | Phe | Thr | Ser | Asp | Tyr | Ser | Lys | Tyr | Leu | Asp | Ala | Lys | Ala | Ala | His | Glu | Phe | Ile | Glu | Trp | Leu | Leu | Gln | Ser |
| 587 | 6129 | 587 | | His | AiB | His | Gly | Thr | Phe | Thr | Ser | Asp | Tyr | Ser | Lys | Tyr | Leu | Asp | Ala | Lys | Arg | Ala | His | Glu | Phe | Ile | Glu | Trp | Leu | Leu | Gln | Gly |
| 588 | 6130 | 588 | | His | AiB | His | Gly | Thr | Phe | Thr | Ser | Asp | Tyr | Ser | Lys | Tyr | Leu | Asp | Ala | Lys | Arg | Ala | His | Gln | Phe | Ile | Glu | Trp | Leu | Leu | Gln | Ser |
| 589 | 6131 | 589 | | His | AiB | His | Gly | Thr | Phe | Thr | Ser | Asp | Tyr | Ser | Lys | Tyr | Leu | Glu | Ala | Lys | Arg | Ala | His | Gln | Phe | Ile | Glu | Trp | Leu | Leu | Gln | Ser |
| 590 | 6132 | 590 | | His | AiB | His | Gly | Thr | Phe | Thr | Ser | Asp | Tyr | Ser | Lys | Tyr | Leu | Asp | Ala | Lys | Arg | Ala | Arg | Gln | Phe | Ile | Glu | Trp | Leu | Leu | Gln | Ser |
| 591 | 6133 | 591 | | His | AiB | His | Gly | Thr | Phe | Thr | Ser | Asp | Tyr | Ser | Lys | Tyr | Leu | Asp | Ala | Lys | Arg | Ala | His | Glu | Phe | Ile | Glu | Trp | Leu | Leu | Gln | Ser |
| 592 | 6134 | 592 | | His | AiB | His | Gly | Thr | Phe | Thr | Ser | Asp | Tyr | Ser | Lys | Tyr | Leu | Asp | Ala | Lys | Arg | Ala | His | Gln | Phe | Ile | Glu | Trp | Leu | Leu | Gln | Ser |
| 593 | 6135 | 593 | | His | AiB | His | Gly | Thr | Phe | Thr | Ser | Asp | Tyr | Ser | Lys | Tyr | Leu | Asp | Ala | Lys | Arg | Ala | His | Gln | Phe | Ile | Glu | Trp | Leu | Leu | Gln | Ser |
| 594 | 6136 | 594 | | His | AiB | His | Gly | Thr | Phe | Thr | Ser | Asp | Tyr | Ser | Lys | Tyr | Leu | Asp | Ala | Lys | Ala | Val | Arg | Leu | Phe | Ile | Glu | Trp | Leu | Lys | Asn | Gly |
| 595 | 6137 | 595 | | His | AiB | His | Gly | Thr | Phe | Thr | Ser | Asp | Tyr | Ser | Lys | Tyr | Leu | Asp | Ala | Lys | Ala | Val | Arg | Leu | Phe | Ile | Glu | Trp | Leu | Lys | Asn | Ser |
| 596 | 6138 | 596 | | His | AiB | His | Gly | Thr | Phe | Thr | Ser | Asp | Tyr | Ser | Lys | Tyr | Leu | Asp | Ala | Lys | Arg | Ala | His | Glu | Phe | Ile | Glu | Trp | Leu | Leu | Gln | Ser |
| 597 | 6143 | 597 | | His | AiB | His | Gly | Thr | Phe | Thr | Ser | Asp | Tyr | Ser | Lys | Tyr | Leu | Asp | Ala | Lys | Arg | Ala | His | Gln | Phe | Ile | Glu | Trp | Leu | Leu | Gln | Ser |
| 598 | 6144 | 598 | | His | AiB | His | Gly | Thr | Phe | Thr | Ser | Asp | Tyr | Ser | Lys | Tyr | Leu | Asp | Ala | Lys | Arg | Ala | His | Gln | Phe | Ile | Glu | Trp | Leu | Leu | Gln | Ser |
| 599 | 6146 | 599 | | His | AiB | His | Gly | Thr | Phe | Thr | Ser | Asp | Tyr | Ser | Lys | Tyr | Leu | Asp | Ala | Lys | Arg | Ala | His | Gln | Phe | Ile | Glu | Trp | Leu | Leu | Gln | Ser |
| 600 | 6147 | 600 | | His | AiB | His | Gly | Thr | Phe | Thr | Ser | Asp | Tyr | Ser | Lys | Tyr | Leu | Asp | Ala | Lys | Arg | Ala | His | Gln | Phe | Ile | Glu | Trp | Leu | Lys | Asn | Gly |
| 601 | 6148 | 601 | | His | AiB | His | Gly | Thr | Phe | Thr | Ser | Asp | Tyr | Ser | Lys | Tyr | Leu | Asp | Ala | Lys | Arg | Ala | His | Gln | Phe | Ile | Glu | Trp | Leu | Lys | Asn | Ser |
| 602 | 6150 | 602 | | His | AiB | His | Gly | Thr | Phe | Thr | Ser | Asp | Tyr | Ser | Lys | Tyr | Leu | Asp | Ala | Lys | Arg | Ala | His | Gln | Phe | Ile | Glu | Trp | Leu | Leu | Gln | Ser |
| 603 | 6151 | 603 | | His | AiB | His | Gly | Thr | Phe | Thr | Ser | Asp | Tyr | Ser | Lys | Tyr | Leu | Asp | Ala | Lys | Arg | Ala | His | Gln | Phe | Ile | Glu | Trp | Leu | Leu | Gln | Ser |
| 604 | 6152 | 604 | | His | AiB | His | Gly | Thr | Phe | Thr | Ser | Asp | Tyr | Ser | Lys | Tyr | Leu | Asp | Ala | Lys | Arg | Ala | His | Glu | Phe | Ile | Glu | Trp | Leu | Leu | Gln | Ser |
| 605 | 6153 | 605 | | His | AiB | His | Gly | Thr | Phe | Thr | Ser | Asp | Tyr | Ser | Lys | Tyr | Leu | Asp | Ala | Lys | Arg | Ala | His | Gln | Phe | Ile | Glu | Trp | Leu | Leu | Gln | Ser |

Figure 2 (Continued)

| 30 | 31 | 32 | 33 | 34 | 35 | 36 | 37 | 38 | 39 | 40 | 41 | 42 | 43 | 44 | 45 | 46 | 47 | 48 | Z | n (R=Cn) | Ex | n | potent | food |
|---|---|---|---|---|---|---|---|---|---|---|---|---|---|---|---|---|---|---|---|---|---|---|---|---|
| His | Pro | Ser | Ser | Gly | Ala | Pro | Pro | Pro | Gly | | | Lys | | | | | | | i | 18 | 566 | | | |
| Gly | Pro | His | Ser | Gly | Ala | Pro | Pro | Pro | Gly | | | Lys | | | | | Asn | His | i | 16 | 567 | 1 | 2 | 0.0 |
| Gly | His | Ser | Ser | Gly | Ala | Pro | Pro | Pro | Gly | | | Lys | | | | | Asn | His | i | 16 | 568 | 1 | 1 | 0.0 |
| His | Pro | Ser | Ser | Gly | Ala | Pro | Pro | Pro | Gly | | | Lys | | | | | Asn | His | i | 16 | 569 | | | |
| Gly | Ser | Ser | Ser | Gly | Ala | Pro | Pro | Pro | Gly | | | Lys | | | | | | | i | 18 | 570 | 1 | 1 | 0.0 |
| His | Pro | Ser | Ser | Gly | Ala | Pro | Pro | Pro | | | | Lys | | | | | | | i | 18 | 571 | | | |
| His | Pro | Ser | Ser | Gly | Ala | Pro | Pro | Pro | | | | Lys | | | | | Asn | His | i | 18 | 572 | | | |
| Gly | Pro | His | Ser | Gly | Ala | Pro | Pro | Pro | | | | Lys | | | | | Asn | His | i | 18 | 573 | | | |
| Gly | His | Ser | Ser | Gly | Ala | Pro | Pro | Pro | | | | Lys | | | | | Asn | His | i | 18 | 574 | | | |
| His | Pro | Ser | Ser | Gly | Ala | Pro | Pro | | | | | Lys | | | | | | | i | 18 | 575 | | | |
| Gly | Pro | Ser | Ser | Gly | Ala | Pro | Pro | | | | | Lys | | | | | Asn | His | i | 18 | 576 | | | |
| His | Pro | Ser | Ser | Gly | Ala | Pro | Pro | | | | | Lys | | | | | Asn | His | i | 18 | 577 | | | |
| Gly | His | Ser | Ser | Gly | Ala | Pro | Pro | | | | | Lys | | | | | Asn | His | i | 18 | 578 | 1 | 9 | 0.0 |
| Gly | His | Ser | Pro | Ser | Pro | Pro | Pro | Pro | | | | Lys | | | | | Asn | His | i | 16 | 579 | | | |
| Gly | Gln | Pro | Ser | Pro | Pro | Pro | Pro | Pro | | | | Lys | | | | | Asn | His | i | 16 | 580 | | | |
| His | Gln | Gln | Pro | Ser | Pro | Pro | Pro | | | | | Lys | | | | | | | i | 18 | 581 | 2 | 5.5 | 5.8 |
| His | His | Glu | Ser | Pro | Pro | Gly | Pro | | | | | Lys | | | | | Asn | His | i | 16 | 582 | 1 | 4.0 | 4.0 |
| His | Gln | Glu | Ser | Pro | Pro | Gly | Pro | | | | | Lys | | | | | Asn | His | i | 16 | 583 | 1 | 4.0 | 4.0 |
| His | Gln | His | Glu | Gly | Ala | Pro | Pro | | | | | Lys | | | | | Asn | His | i | 16 | 584 | 1 | 5.0 | 5.0 |
| Gln | Gln | Ser | Ser | Gly | Ala | Pro | Pro | Pro | | | | Lys | | | | | | | i | 18 | 585 | | | |
| His | Gln | Ser | Ser | Gly | Ala | Pro | Pro | Pro | | | | Lys | | | | | Asn | His | i | 18 | 586 | | | |
| His | Gln | His | Ser | Ser | Ser | Pro | Pro | Pro | | | | Lys | | | | Gly | Gly | Ser | i | 16 | 587 | 5 | 6.8 | 7.2 |
| His | Gln | His | Ser | Glu | Ser | Pro | Pro | Pro | | | Thr | Lys | | | | Gly | Ser | Gly | i | 18 | 588 | 2 | 5.5 | 5.5 |
| His | Gln | Gln | Ser | Glu | Ser | Pro | Pro | Pro | | | Thr | Lys | | | | Gly | Ser | Gly | i | 18 | 589 | 1 | 5.0 | 5.0 |
| His | Gln | Gln | Ser | Ser | Pro | Pro | Pro | Pro | | | | Lys | | | | | | | i | 18 | 590 | 2 | 5.3 | 5.3 |
| His | Gln | Gln | Ser | Ser | Ala | Pro | Pro | Pro | | | | Lys | | | | | Asn | His | i | 16 | 591 | 1 | 5.0 | 5.0 |
| His | Gln | Gln | Ser | Glu | Ala | Pro | Pro | Pro | | | | Lys | | | | | | Asn | i | 16 | 592 | 1 | 4.0 | 4.0 |
| His | Gln | Gln | Glu | Ser | Ala | Pro | Pro | Pro | | | | Lys | | | | | Gly | Gly | i | 16 | 593 | 1 | 4.0 | 4.0 |
| His | Gln | His | Ser | Ser | Ala | Pro | Pro | Pro | | | | Lys | | | | | | Gly | i | 16 | 594 | 1 | 4.0 | 4.0 |
| His | Gln | Gln | Ser | Ser | Ala | Pro | Pro | Pro | | | | Lys | | | | | | | i | 18 | 595 | 1 | 5.0 | 5.0 |
| His | Gln | Gln | Ser | Ser | Ser | Pro | Pro | Pro | | | | Lys | | | | | | | i | 18 | 596 | | | |
| His | Gln | Gln | Ser | Ser | Pro | Pro | Pro | Pro | | | | Lys | | | | | Asn | | i | 18 | 597 | 2 | 6.0 | 6.0 |
| His | Gln | Gln | Ser | Ser | Pro | Pro | Pro | Pro | | Pro | | Lys | | | | | Asn | | i | 18 | 598 | 2 | 5.5 | 5.5 |
| His | Gln | Gln | Gln | Glu | Gly | Ala | Pro | Pro | | Pro | | Lys | | | | | | | i | 18 | 599 | 2 | 5.5 | 5.5 |
| His | Gln | Gln | Glu | Ser | Gly | Ala | Pro | Pro | | Pro | | Lys | | | | | Gly | Ser | i | 16 | 600 | 2 | 5.0 | 5.0 |
| His | Gln | Gln | Gln | His | Ser | Ser | Pro | Pro | | | | Lys | | | | | | | i | 18 | 601 | 2 | 5.3 | 5.3 |
| His | Gln | Gln | Gln | His | Glu | Ser | Pro | Pro | | | | Lys | | | | | Asn | Asn | i | 18 | 602 | 1 | 5.0 | 5.0 |
| His | His | Gln | Gln | His | Glu | Pro | Pro | Pro | | | | Lys | | | | | Asn | Asn | i | 18 | 603 | 1 | 4.5 | 4.5 |
| His | His | Gln | Gln | His | Glu | Pro | Pro | Pro | | | | Lys | | | | | Asn | Asn | i | 18 | 604 | 1 | 5.0 | 5.0 |
| His | His | Gln | Gln | His | Glu | Pro | Pro | Pro | Pro | | | Lys | | | | | Asn | Asn | i | 18 | 605 | 1 | 8.0 | 7.0 |

Figure 2 (Continued)

| Ex | G ref | SEQ ID | Note | 1 | 2 | 3 | 4 | 5 | 6 | 7 | 8 | 9 | 10 | 11 | 12 | 13 | 14 | 15 | 16 | 17 | 18 | 19 | 20 | 21 | 22 | 23 | 24 | 25 | 26 | 27 | 28 | 29 |
|---|---|---|---|---|---|---|---|---|---|---|---|---|---|---|---|---|---|---|---|---|---|---|---|---|---|---|---|---|---|---|---|---|
| 606 | 6154 | 606 | | His | AiB | His | Gly | Thr | Phe | Thr | Ser | Asp | Tyr | Ser | Lys | Tyr | Leu | Asp | Ala | Lys | Arg | Ala | His | Glu | Phe | Ile | Glu | Trp | Leu | Leu | Gln | Ser |
| 607 | 6159 | 607 | | His | AiB | His | Gly | Thr | Phe | Thr | Ser | Asp | Leu | Ser | Lys | Gln | Leu | Glu | Glu | Glu | Arg | Val | Arg | Leu | Phe | Ile | Glu | Trp | Leu | Lys | Gln | Gly |
| 608 | 6160 | 608 | | His | AiB | His | Gly | Thr | Phe | Thr | Ser | Asp | Leu | Ser | Lys | Gln | Leu | Glu | Glu | Glu | Arg | Val | Arg | Leu | Phe | Ile | Glu | Trp | Leu | Lys | Asn | Gly |
| 609 | 6161 | 609 | | His | AiB | His | Gly | Thr | Phe | Thr | Ser | Asp | Leu | Ser | Lys | Gln | Leu | Glu | Glu | Glu | Ala | Val | Arg | Leu | Phe | Ile | Glu | Trp | Leu | Lys | Asn | Gly |
| 610 | 6162 | 610 | | His | AiB | His | Gly | Thr | Phe | Thr | Ser | Asp | Leu | Ser | Lys | Gln | Leu | Glu | Glu | Glu | Arg | Val | Arg | Leu | Phe | Ile | Glu | Trp | Leu | Lys | Asn | Gly |
| 611 | 6165 | 611 | | His | AiB | His | Gly | Thr | Phe | Thr | Ser | Asp | Leu | Ser | Lys | Gln | Leu | Glu | Glu | Glu | Arg | Val | Arg | Leu | Phe | Ile | Glu | Trp | Leu | Lys | Asn | Gly |
| 612 | 6166 | 612 | | His | AiB | His | Gly | Thr | Phe | Thr | Ser | Asp | Leu | Ser | Lys | Gln | Leu | Glu | Gln | Glu | Arg | Val | Arg | Leu | Phe | Ile | Glu | Trp | Leu | Lys | Asn | Gly |
| 613 | 6167 | 613 | | His | AiB | His | Gly | Thr | Phe | Thr | Ser | Asp | Leu | Ser | Lys | Gln | Leu | Glu | Glu | Glu | Arg | Val | Arg | Leu | Phe | Ile | Glu | Trp | Leu | Lys | Asn | Gly |
| 614 | 6168 | 614 | | His | AiB | His | Gly | Thr | Phe | Thr | Ser | Asp | Leu | Ser | Lys | Gln | Leu | Glu | Gln | Glu | Arg | Val | Arg | Leu | Phe | Ile | Glu | Trp | Leu | Lys | Asn | Gly |
| 615 | 6169 | 615 | | His | AiB | His | Gly | Thr | Phe | Thr | Ser | Asp | Leu | Ser | Lys | Gln | Leu | Glu | Glu | Glu | Arg | Val | Arg | Leu | Phe | Ile | Glu | Trp | Leu | Lys | Asn | Gly |
| 616 | 6170 | 616 | | His | AiB | His | Gly | Thr | Phe | Thr | Ser | Asp | Leu | Ser | Lys | Gln | Leu | Glu | Gln | Glu | Ala | Val | Arg | Leu | Phe | Ile | Glu | Trp | Leu | Lys | Asn | Gly |
| 617 | 6171 | 617 | | His | AiB | His | Gly | Thr | Phe | Thr | Ser | Asp | Leu | Ser | Lys | Gln | Leu | Glu | Gln | Glu | Ala | Val | Arg | Leu | Phe | Ile | Glu | Trp | Leu | Lys | Asn | Gly |
| 618 | 6172 | 618 | | His | AiB | His | Gly | Thr | Phe | Thr | Ser | Asp | Leu | Ser | Lys | Gln | Leu | Glu | Gln | Glu | Ala | Val | Arg | Leu | Phe | Ile | Glu | Trp | Leu | Lys | Asn | Gly |
| 619 | 6173 | 619 | | His | AiB | His | Gly | Thr | Phe | Thr | Ser | Asp | Leu | Ser | Lys | Gln | Leu | Glu | Gln | Glu | Ala | Val | Arg | Leu | Phe | Ile | Glu | Trp | Leu | Lys | Asn | Gly |
| 620 | 6174 | 620 | | His | AiB | His | Gly | Thr | Phe | Thr | Ser | Asp | Leu | Ser | Lys | Gln | Leu | Glu | Gln | Glu | Ala | Val | Arg | Leu | Phe | Ile | Glu | Trp | Leu | Lys | Asn | Gly |
| 621 | 6175 | 621 | | His | AiB | His | Gly | Thr | Phe | Thr | Ser | Asp | Tyr | Ser | Arg | Tyr | Leu | Asp | Ala | Lys | Arg | Ala | Arg | Glu | Phe | Ile | Glu | Trp | Leu | Leu | Gln | Ser |
| 622 | 6176 | 622 | | His | AiB | His | Gly | Thr | Phe | Thr | Ser | Asp | Tyr | Ser | Arg | Tyr | Leu | Asp | Ala | Lys | Arg | Ala | Arg | Glu | Phe | Ile | Glu | Trp | Leu | Leu | Gln | Ser |
| 623 | 6177 | 623 | | His | AiB | His | Gly | Thr | Phe | Thr | Ser | Asp | Tyr | Ser | Arg | Tyr | Leu | Asp | Ala | Lys | Arg | Ala | Arg | Glu | Phe | Ile | Glu | Trp | Leu | Leu | Gln | Ser |
| 624 | 6178 | 624 | | His | AiB | His | Gly | Thr | Phe | Thr | Ser | Asp | Tyr | Ser | Arg | Tyr | Leu | Asp | Ala | Lys | Arg | Ala | Arg | Glu | Phe | Ile | Glu | Trp | Leu | Leu | Gln | Ser |
| 625 | 6179 | 625 | | His | AiB | His | Gly | Thr | Phe | Thr | Ser | Asp | Tyr | Ser | Arg | Tyr | Leu | Asp | Ala | Lys | Arg | Ala | Arg | Glu | Phe | Ile | Glu | Trp | Leu | Leu | Gln | Ser |
| 626 | 6180 | 626 | | His | AiB | His | Gly | Thr | Phe | Thr | Ser | Asp | Tyr | Ser | Arg | Tyr | Leu | Asp | Ala | Lys | Arg | Ala | Arg | Glu | Phe | Ile | Glu | Trp | Leu | Leu | Gln | Ser |
| 627 | 6181 | 627 | | His | AiB | His | Gly | Thr | Phe | Thr | Ser | Asp | Tyr | Ser | Arg | Tyr | Leu | Asp | Ala | Lys | Arg | Ala | Gln | Glu | Phe | Ile | Glu | Trp | Leu | Leu | Gln | Ser |
| 628 | 6182 | 628 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 629 | 6183 | 629 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 630 | 6184 | 630 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 631 | 6193 | 631 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 632 | 6194 | 632 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 633 | 6195 | 633 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 634 | 6196 | 634 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 635 | 6197 | 635 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 636 | 6201 | 636 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 637 | 6202 | 637 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 638 | 6203 | 638 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 639 | 6204 | 639 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 640 | 6212 | 640 | Dup Ex737 | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 641 | 6213 | 641 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 642 | 6214 | 642 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 643 | 6215 | 643 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 644 | 6216 | 644 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 645 | 6216 | 645 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |

Figure 2 (Continued)

| 30 | 31 | 32 | 33 | 34 | 35 | 36 | 37 | 38 | 39 | 40 | 41 | 42 | 43 | 44 | 45 | 46 | 47 | 48 | Z | n (R=C$_n$) | Ex | n | potent | food |
|---|---|---|---|---|---|---|---|---|---|---|---|---|---|---|---|---|---|---|---|---|---|---|---|---|
| His | Gln | His | Glu | Ser | Pro | Pro | Pro | | | | | | | | | | | | - | 18 | 606 | 1 | 4.0 | 4.0 |
| Gly | Pro | Ser | His | Gly | Ala | Pro | Pro | Pro | | | | Lys | | | | | | Asn | - | 16 | 607 | 1 | 15 | 0.0 |
| Gly | Pro | Ser | His | Gly | His | Pro | Pro | Pro | | | | Lys | | | | | Asn | His | - | 16 | 608 | | | |
| Gly | Pro | Ser | His | Gly | His | Pro | Pro | Pro | | | | Lys | | | | | Asn | His | - | 16 | 609 | | | |
| Gly | Pro | Ser | His | Gly | His | Pro | Pro | Pro | | | | Lys | | | | | Asn | His | - | 16 | 610 | | | |
| Gly | Pro | Ser | His | Gly | His | Pro | Pro | Pro | | | | Lys | | | | | | | - | 16 | 611 | | 4 | 1.2 |
| Gly | Pro | Ser | His | Gly | His | Pro | Pro | Pro | | | | Lys | | | | | Asn | His | - | 16 | 612 | | | |
| Gly | Pro | Ser | His | Gly | His | Pro | Pro | Pro | | | | Lys | | | | | | | - | 16 | 613 | | | |
| Gly | Pro | Ser | His | Gly | His | Pro | Pro | Pro | | | | Lys | | | | | | | - | 18 | 614 | 1 | 5 | 0.0 |
| Gly | Pro | Ser | His | Gly | His | Pro | Pro | Pro | | | | Lys | | | | | | | - | 18 | 615 | 1 | 7 | 0.0 |
| Gly | Pro | Ser | His | Gly | His | Pro | Pro | Pro | | | | Lys | | | | | | | - | 18 | 616 | | | |
| Gly | Pro | Ser | His | Gly | His | Pro | Pro | Pro | | | | Lys | | | | | | | - | 18 | 617 | | | |
| Gly | Pro | Ser | His | Gly | His | Pro | Pro | Pro | | | | Lys | | | | | Asn | His | - | 16 | 618 | | | |
| Gly | Pro | Ser | His | Gly | His | Pro | Pro | Pro | | | | Lys | | | | | Asn | His | - | 16 | 619 | | | |
| Gly | Pro | Ser | His | Gly | His | Pro | Pro | Pro | | | | Lys | | | | | Asn | His | - | 16 | 620 | | | |
| His | Gln | Gln | Gln | His | Glu | Ser | Pro | Pro | Pro | | | Lys | | | | | | Asn | - | 18 | 621 | | | |
| His | Gln | Gln | Gln | His | Glu | Ser | Pro | Pro | Pro | | | Lys | | | | | | | - | 18 | 622 | 1 | 6 | 6.0 |
| His | Gln | Gln | Gln | His | Glu | Ser | Pro | Pro | Pro | | | Lys | | | | | | Asn | - | 18 | 623 | 1 | 2.0 | 2.0 |
| His | Gln | Gln | Gln | His | Glu | Ser | Pro | Pro | Pro | | | Lys | | | | | | Asn | - | 18 | 624 | 1 | 4.0 | 4.0 |
| His | Gln | Gln | Gln | His | Glu | Ser | Pro | Pro | Pro | | | Lys | | | | | | Asn | - | 18 | 625 | 1 | 1.0 | 1.0 |
| His | Gln | Gln | Gln | His | Glu | Ser | Pro | Pro | Pro | | | Lys | | | | | | | - | 18 | 626 | 1 | 5.0 | 5.0 |
| His | Gln | Gln | Gln | His | Glu | Ser | Pro | Pro | Pro | | | Lys | | | | | | | - | 18 | 627 | 1 | 4.0 | 4.0 |
| His | Gln | Gln | Gln | His | Glu | Ser | Pro | Pro | Pro | | | Lys | | | | | | Asn | - | 16 | 628 | 3 | 4.0 | 4.0 |
| His | Gln | Gln | Gln | His | Glu | Ser | Pro | Pro | Pro | | | Lys | | | | | | Asn | - | 16 | 629 | 1 | 5.8 | 5.8 |
| His | Gln | Gln | Gln | His | Glu | Ser | Pro | Pro | Pro | Gly | | Lys | | | | | | Asn | - | 18 | 630 | 1 | 4.0 | 4.0 |
| His | Gln | Gln | Gln | His | Glu | Ser | Pro | Pro | Pro | Gly | | Lys | | | Thr | Gly | Ser | Gly | - | 18 | 631 | 1 | 4.0 | 4.0 |
| His | Gln | Gln | Gln | His | Glu | Ser | Pro | Pro | Pro | Gly | | Lys | | | | | | Asn | - | 18 | 632 | 1 | 4.0 | 4.0 |
| His | Gln | Gln | Gln | His | Glu | Ser | Pro | Pro | Pro | Gly | | Lys | | | | | Asn | His | - | 16 | 633 | 1 | 3.5 | 4.0 |
| His | Gln | Gln | Gln | His | Glu | Ser | Pro | Pro | | Gly | | Lys | | | | | Asn | | - | 16 | 634 | 1 | 3.5 | 4.0 |
| Gln | Gln | His | Glu | Ser | Pro | Ser | Pro | Gly | Pro | | | Lys | | | Thr | Gly | Ser | Gly | - | 18 | 635 | 2 | 5.5 | 5.5 |
| His | Gln | His | Gln | His | Pro | Ser | Pro | Pro | Pro | | | Lys | | | | | Asn | His | - | 18 | 636 | 2 | 4.8 | 4.8 |
| His | Gln | His | Gln | His | Glu | Ser | Pro | Pro | Pro | | | Lys | | | | | Asn | Gly | - | 16 | 637 | 3 | 6.2 | 6.3 |
| His | Gln | Gln | Gln | His | Glu | Ser | Pro | Pro | Pro | Gly | | Lys | | | | | | | - | 18 | 638 | 1 | 4.0 | 4.0 |
| His | Gln | Gln | Gln | His | Glu | Ser | Pro | Pro | Pro | Gly | | Lys | | | | | | Asn | - | 18 | 639 | 1 | 4.0 | 4.0 |
| His | Gln | Gln | Gln | His | Glu | Ser | Pro | Pro | Pro | | | Lys | | | | | Asn | His | - | 16 | 640 | 4 | 6.8 | 6.9 |
| His | Gln | Gln | Gln | His | Glu | Ser | Pro | Pro | Pro | Gly | | Lys | | | | | Asn | | - | 16 | 641 | 2 | 5.5 | 6.0 |
| His | Gln | Gln | Gln | His | Glu | Ser | Pro | Pro | Pro | Gly | | Lys | | | | | | | - | 18 | 642 | 4 | 6.9 | 7.4 |
| His | Gln | Gln | Gln | His | Pro | Ser | Pro | Pro | Pro | | | Lys | | | | | Asn | | - | 18 | 643 | 1 | 5.0 | 5.0 |
| His | Gln | Gln | Gln | His | Glu | Ser | Pro | Pro | Pro | | | Lys | | | | | Asn | His | - | 16 | 644 | 4 | 5.9 | 6.3 |
| His | Gln | Gln | Gln | His | Glu | Ser | Pro | Pro | Pro | | | Lys | | | | | Asn | His | - | 16 | 645 | 2 | 5.8 | 5.8 |

Figure 2 (Continued)

| Ex | G ref | SEQ ID | Note | 1 | 2 | 3 | 4 | 5 | 6 | 7 | 8 | 9 | 10 | 11 | 12 | 13 | 14 | 15 | 16 | 17 | 18 | 19 | 20 | 21 | 22 | 23 | 24 | 25 | 26 | 27 | 28 | 29 |
|---|---|---|---|---|---|---|---|---|---|---|---|---|---|---|---|---|---|---|---|---|---|---|---|---|---|---|---|---|---|---|---|---|
| 646 | 6218 | 646 | Dup Ex692 | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 647 | 6219 | 647 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 648 | 6220 | 648 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 649 | 6221 | 649 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 650 | 6222 | 650 | | His | AiB | His | Gly | Thr | Phe | Thr | Ser | Asp | Tyr | Ser | Lys | Tyr | Leu | Asp | Ala | Lys | Arg | Ala | His | Glu | Phe | Ile | Glu | Trp | Leu | Leu | Gln | Ser |
| 651 | 6223 | 651 | | His | AiB | His | Gly | Thr | Phe | Thr | Ser | Asp | Tyr | Ser | Lys | Tyr | Leu | Asp | Ala | Lys | Arg | Ala | His | Glu | Phe | Ile | Glu | Trp | Leu | Leu | Gln | Ser |
| 652 | 6224 | 652 | Dup Ex693 | His | AiB | His | Gly | Thr | Phe | Thr | Ser | Asp | Tyr | Ser | Lys | Tyr | Leu | Asp | Ala | Lys | Arg | Ala | His | Glu | Phe | Ile | Glu | Trp | Leu | Leu | Gln | Ser |
| 653 | 6228 | 653 | | His | AiB | His | Gly | Thr | Phe | Thr | Ser | Asp | Tyr | Ser | Lys | Tyr | Leu | Asp | Ala | Lys | Arg | Ala | His | Glu | Phe | Ile | Glu | Trp | Leu | Leu | Gln | Ser |
| 654 | 6229 | 654 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 655 | 6230 | 655 | | His | AiB | His | Gly | Thr | Phe | Thr | Ser | Asp | Leu | Ser | Lys | Gln | Leu | Glu | Glu | Lys | Arg | Val | Arg | Leu | Phe | Ile | Glu | Trp | Leu | Lys | Asn | Gly |
| 656 | 6231 | 656 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 657 | 6232 | 657 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 658 | 6233 | 658 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 659 | 6234 | 659 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 660 | 6235 | 660 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 661 | 6236 | 661 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 662 | 6238 | 662 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 663 | 6261 | 663 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 664 | 6265 | 664 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 665 | 6267 | 665 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 666 | 6268 | 666 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 667 | 6269 | 667 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 668 | 6270 | 668 | | His | AiB | His | Gly | Thr | Phe | Thr | Ser | Asp | Tyr | Ser | Lys | Tyr | Leu | Asp | Ala | Lys | Arg | Ala | His | Glu | Phe | Ile | Glu | Trp | Leu | Leu | Gln | Ser |
| 669 | 6271 | 669 | | His | AiB | His | Gly | Thr | Phe | Thr | Ser | Asp | Tyr | Ser | Lys | Tyr | Leu | Asp | Ala | Lys | Arg | Ala | His | Glu | Phe | Ile | Glu | Trp | Leu | Leu | Gln | Ser |
| 670 | 6279 | 670 | | His | AiB | His | Gly | Thr | Phe | Thr | Ser | Asp | Tyr | Ser | Lys | Tyr | Leu | Asp | Ala | Lys | Arg | Ala | His | Glu | Phe | Ile | Glu | Trp | Leu | Leu | Gln | Ser |
| 671 | 6280 | 671 | | His | AiB | His | Gly | Thr | Phe | Thr | Ser | Asp | Tyr | Ser | Lys | Tyr | Leu | Asp | Ala | Lys | Arg | Ala | His | Glu | Phe | Ile | Glu | Trp | Leu | Leu | Gln | Ser |
| 672 | 6282 | 672 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 673 | 6285 | 673 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 674 | 6287 | 674 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 675 | 6289 | 675 | | His | AiB | His | Gly | Thr | Phe | Thr | Ser | Asp | Tyr | Ser | Lys | Tyr | Leu | Asp | Ala | Lys | Arg | Ala | His | Glu | Phe | Ile | Glu | Trp | Leu | Leu | Gln | Ser |
| 676 | 6290 | 676 | | His | AiB | His | Gly | Thr | Phe | Thr | Ser | Asp | Tyr | Ser | Lys | Tyr | Leu | Asp | Ala | Lys | Arg | Ala | His | Glu | Phe | Ile | Glu | Trp | Leu | Leu | Gln | Ser |
| 677 | 6291 | 677 | | His | AiB | His | Gly | Thr | Phe | Thr | Ser | Asp | Tyr | Ser | Lys | Tyr | Leu | Asp | Ala | Lys | Arg | Ala | His | Glu | Phe | Ile | Glu | Trp | Leu | Leu | Gln | Ser |
| 678 | 6292 | 678 | | His | AiB | His | Gly | Thr | Phe | Thr | Ser | Asp | Tyr | Ser | Lys | Tyr | Leu | Asp | Ala | Lys | Arg | Ala | His | Glu | Phe | Ile | Glu | Trp | Leu | Leu | Gln | Ser |
| 679 | 6306 | 679 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 680 | 6309 | 680 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 681 | 6310 | 681 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 682 | 6311 | 682 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 683 | 6313 | 683 | Dup Ex243 | His | AiB | His | Gly | Thr | Phe | Thr | Ser | Asp | Tyr | Ser | Arg | Tyr | Leu | Asp | Ala | Lys | Arg | Ala | Gln | Glu | Phe | Ile | Glu | Trp | Leu | Leu | Gln | Ser |
| 684 | 6314 | 684 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | His | His | Gly |
| 685 | 6315 | 685 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |

Figure 2 (Continued)

| 30 | 31 | 32 | 33 | 34 | 35 | 36 | 37 | 38 | 39 | 40 | 41 | 42 | 43 | 44 | 45 | 46 | 47 | 48 | Z | n (R=C$_n$) | Ex | n | potent | food |
|---|---|---|---|---|---|---|---|---|---|---|---|---|---|---|---|---|---|---|---|---|---|---|---|---|
| His | His | Gln | Gln | His | Glu | Ser | Pro | Pro | Pro | Gly | | Lys | Lys | | | | | | i | 18 | 646 | 4 | 7.5 | 7.8 |
| His | His | Gln | Gln | His | Glu | Ser | Pro | Pro | Pro | Gly | | Lys | Lys | | | | | Asn | i | 18 | 647 | 7 | 6.7 | 6.4 |
| His | His | Gln | Gln | His | Glu | Pro | Pro | Pro | Pro | | | Lys | Lys | | | | Asn | His | i | 16 | 648 | 1 | 6.0 | 6.0 |
| His | His | Gln | Gln | Ser | Glu | Pro | Pro | Pro | Pro | | | Lys | Lys | | | | Asn | His | i | 16 | 649 | 3 | 6.2 | 6.5 |
| His | His | Gln | Gln | Ser | Pro | Pro | Pro | Gly | | | | Lys | Lys | | | | | | i | 18 | 650 | 1 | 5.0 | 5.0 |
| His | His | Gln | His | Glu | Ser | Pro | Pro | Pro | Pro | | | Lys | Lys | | | | | Asn | i | 18 | 651 | 2 | 5.5 | 5.0 |
| His | His | Gln | His | Glu | Ser | Pro | Pro | Gly | Gly | | | Lys | Lys | | | | | Asn | i | 18 | 652 | 5 | 8.0 | 8.2 |
| His | His | Gln | His | Ser | Pro | Pro | Pro | Pro | Pro | | | Lys | Lys | | | | | | i | 18 | 653 | 1 | 6.0 | 6.0 |
| His | His | Gln | His | Ser | Glu | Ser | Pro | Pro | Pro | | | Lys | Lys | | | | | | i | 18 | 654 | 1 | 5 | 5.0 |
| Gln | His | Gln | His | Ser | Glu | Ser | Pro | Pro | Pro | | | Lys | Lys | | | | | | i | 18 | 655 | 2 | 6.5 | 6.0 |
| Gln | His | Gln | Gln | His | Glu | Ser | Pro | Pro | Pro | | | Lys | Lys | | | | | | i | 18 | 656 | 2 | 6.0 | 5.5 |
| His | His | Gln | His | His | Glu | Ser | Pro | Pro | Pro | | | Lys | Lys | | | | | | i | 18 | 657 | 1 | 6.0 | 6.0 |
| His | His | Gln | His | Gly | His | Pro | Pro | Pro | Pro | | | Lys | Lys | | | | | | i | 18 | 658 | 1 | 7.0 | 6.0 |
| Gly | Pro | Ser | His | Ser | Pro | Pro | Pro | Pro | Pro | | | Lys | Lys | | | | | | i | 18 | 659 | 1 | 5.3 | 5.3 |
| Gln | Gln | His | Glu | Ser | Ser | Gly | Ala | Pro | Pro | | | Lys | Lys | | | | | | i | 18 | 660 | 3 | 5.0 | 5.0 |
| Gln | Gln | Gln | His | Ser | Ser | Ser | Gly | Ala | Pro | Pro | | Lys | Lys | | | | | | i | 18 | 661 | 1 | 7 | 0.8 |
| Gln | Gln | Gln | His | Ser | Ser | Ser | Gly | Ala | Pro | Gly | | Lys | Lys | | | | | | i | 18 | 662 | 2 | 6.3 | 6.0 |
| Gln | Gln | Gln | His | Ser | Ser | Ser | Gly | Ala | Gly | | | Lys | Lys | | | | | | i | 18 | 663 | 2 | 6.5 | 6.5 |
| Gln | Gln | Gln | Ser | Ser | Ala | Gly | Ala | Ser | | | | Lys | Lys | | | | | | i | 18 | 664 | 5 | 7.3 | 7.8 |
| His | Gln | Gln | Glu | Glu | Ser | Ser | Gly | Gly | | | | Lys | Lys | | | | | | i | 18 | 665 | 2 | 5.0 | 5.5 |
| His | Gln | Gln | Glu | Glu | Ser | Gly | Ala | Gly | | | | Lys | Lys | | | | | | i | 18 | 666 | 6 | 6.9 | 6.3 |
| His | Gln | Gln | Glu | Glu | Ser | Ser | Ala | Gly | | | | Lys | Lys | | | | | | i | 18 | 667 | 2 | 6.0 | 5.0 |
| His | Gln | Gln | Glu | Glu | Ser | Ser | Ala | | | | | Lys | Lys | | | | Gly | Ser | i | 16 | 668 | 1 | 5.0 | 5.0 |
| Gln | Gln | Gln | His | Ser | Ser | Ser | Ala | | | | | Lys | Lys | | | | Gly | Ser | i | 16 | 669 | 1 | 4.0 | 4.0 |
| Gln | Gln | His | Ser | Ser | Ala | Ser | Ala | | | | | Lys | Lys | | | | | | i | 18 | 670 | 1 | 4.0 | 4.0 |
| His | Gln | Gln | Glu | Glu | Ser | Ser | Ala | | | | | Lys | Lys | | | | Gly | Ser | i | 18 | 671 | 5 | 6.4 | 7.0 |
| His | Gln | Gln | Glu | Glu | Ser | Ser | Ala | | | | | Lys | Lys | | | | | Asn | i | 18 | 672 | 3 | 6.3 | 6.0 |
| His | Gln | His | Glu | Ser | Ser | Ser | Ala | Ser | | | | Lys | Lys | | | | | | i | 18 | 673 | 2 | 6.5 | 6.5 |
| His | Gln | His | Glu | Ser | Ser | Ser | Ala | Gly | | | | Lys | Lys | | | | | | i | 18 | 674 | 1 | 5.5 | 5.5 |
| His | Gln | His | Glu | Glu | Ser | Ser | Ala | Gly | | | | Lys | Lys | | | | | Asn | i | 16 | 675 | 1 | 5.5 | 5.5 |
| His | Gln | His | Glu | Glu | Ser | Ser | Ala | | | | | Lys | Lys | | | | | | i | 16 | 676 | 1 | 5.5 | 5.5 |
| His | Gln | His | Glu | Glu | Ser | Ser | Ala | | | | | Lys | Lys | | | Asn | | | i | 16 | 677 | 3 | 4.0 | 4.0 |
| Gln | Gln | His | Glu | Ser | Ser | Ala | Pro | | | | | Lys | Lys | | | | | | i | 18 | 678 | 1 | 5.5 | 5.8 |
| His | His | Gln | His | Ser | Pro | Pro | Pro | Pro | Ser | | | Lys | Lys | | | | | | i | 16 | 679 | 1 | 4.0 | 4.0 |
| His | His | Gln | His | Ser | Glu | Ser | Pro | Pro | Pro | Ser | Gly | Lys | Lys | | | | | | i | 18 | 680 | 1 | 4.0 | 4.0 |
| His | His | Gln | His | His | Glu | Ser | Pro | Pro | Pro | | | Lys | Lys | | | | | | i | 18 | 681 | 1 | 5.0 | 5.0 |
| His | His | Gln | His | His | Glu | Ser | Gly | Pro | Pro | | | Lys | Lys | | | | | | i | 18 | 682 | 1 | 5.0 | 5.0 |
| His | His | His | His | Glu | Ser | Pro | Pro | Pro | Pro | | | Lys | Lys | | | | | | i | 18 | 683 | | | |
| His | Gln | Gln | His | His | Glu | Ser | Gly | | | | | Lys | Lys | Thr | Gly | Ser | Gly | | i | 16 | 684 | | | |
| His | Gln | Gln | His | His | Glu | Ser | Gly | | | | | Lys | Lys | | | | | | i | 16 | 685 | 5 | 7.3 | 7.1 |

Figure 2 (Continued)

| Ex | G ref | SEQ ID | Note | 1 | 2 | 3 | 4 | 5 | 6 | 7 | 8 | 9 | 10 | 11 | 12 | 13 | 14 | 15 | 16 | 17 | 18 | 19 | 20 | 21 | 22 | 23 | 24 | 25 | 26 | 27 | 28 | 29 |
|---|---|---|---|---|---|---|---|---|---|---|---|---|---|---|---|---|---|---|---|---|---|---|---|---|---|---|---|---|---|---|---|---|
| 686 | 6316 | 686 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 687 | 6317 | 687 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 688 | 6318 | 688 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 689 | 6319 | 689 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 690 | 6336 | 690 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 691 | 6337 | 691 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 692 | 6339 | 692 | Dup Ex646 | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 693 | 6340 | 693 | Dup Ex652 | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 694 | 6343 | 694 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 695 | 6345 | 695 | | His | AiB | His | Gly | Thr | Phe | Thr | Ser | Asp | Tyr | Ser | Lys | Tyr | Leu | Asp | Ala | Lys | Arg | Ala | His | Glu | Phe | Ile | Glu | Trp | Leu | Leu | Gln | Ser |
| 696 | 6346 | 696 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 697 | 6350 | 697 | Dup Ex502 | His | AiB | His | Gly | Thr | Phe | Thr | Ser | Asp | Tyr | Ser | Lys | Tyr | Leu | Asp | Ala | Lys | Arg | Ala | His | Glu | Phe | Ile | Glu | Trp | Leu | Leu | Gln | Ser |
| 698 | 6352 | 698 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 699 | 6357 | 699 | | His | AiB | His | Gly | Thr | Phe | Thr | Ser | Asp | Tyr | Ser | Lys | Tyr | Leu | Asp | Ala | Lys | Arg | Ala | His | Glu | Phe | Ile | Glu | Trp | Leu | Leu | Gln | Ser |
| 700 | 6362 | 700 | Dup Ex652 | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 701 | 6363 | 701 | Dup Ex646 | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 702 | 6364 | 702 | Dup Ex685 | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 703 | 6365 | 703 | Dup Ex671 | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 704 | 6368 | 704 | | His | AiB | His | Gly | Thr | Phe | Thr | Ser | Asp | Tyr | Ser | Lys | Tyr | Leu | Asp | Ala | Lys | Arg | Ala | His | Glu | Phe | Ile | Glu | Trp | Leu | Leu | Gln | Ser |
| 705 | 6370 | 705 | | His | AiB | His | Gly | Thr | Phe | Thr | Ser | Asp | Tyr | Ser | Lys | Tyr | Leu | Asp | Ala | Lys | Arg | Ala | His | Glu | Phe | Ile | Glu | Trp | Leu | Leu | Gln | Ser |
| 706 | 6372 | 706 | Dup Ex734 | His | AiB | His | Gly | Thr | Phe | Thr | Ser | Asp | Tyr | Ser | Lys | Tyr | Leu | Asp | Ala | Lys | Arg | Ala | Arg | Glu | Phe | Ile | Glu | Trp | Leu | Leu | Gln | Ser |
| 707 | 6373 | 707 | Dup Ex722 | His | AiB | His | Gly | Thr | Phe | Thr | Ser | Asp | Tyr | Ser | Lys | Tyr | Leu | Asp | Ala | Lys | Arg | Ala | Arg | Glu | Phe | Ile | Glu | Trp | Leu | Leu | Gln | Ser |
| 708 | 6374 | 708 | Dup Ex725 | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 709 | 6375 | 709 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 710 | 6384 | 710 | | His | AiB | His | Gly | Thr | Phe | Thr | Ser | Asp | Tyr | Ser | Lys | Tyr | Leu | Asp | Ala | Lys | Arg | Ala | His | Glu | Phe | Ile | Glu | Trp | Leu | Leu | Gln | Ser |
| 711 | 6385 | 711 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 712 | 6386 | 712 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 713 | 6429 | 713 | | His | AiB | His | Gly | Thr | Phe | Thr | Ser | Asp | Tyr | Ser | Lys | Tyr | Leu | Asp | Ala | Lys | Arg | Ala | Arg | Glu | Phe | Ile | Glu | Trp | Leu | Leu | Gln | Ser |
| 714 | 6430 | 714 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 715 | 6431 | 715 | | His | AiB | His | Gly | Thr | Phe | Thr | Ser | Asp | Tyr | Ser | Lys | Tyr | Leu | Asp | Ala | Lys | Arg | Ala | Arg | Glu | Phe | Ile | Glu | Trp | Leu | Leu | Gln | Ser |
| 716 | 6432 | 716 | | His | AiB | His | Gly | Thr | Phe | Thr | Ser | Asp | Tyr | Ser | Lys | Tyr | Leu | Asp | Ala | Lys | Arg | Ala | His | Glu | Phe | Ile | Glu | Trp | Leu | Leu | Gln | Ser |
| 717 | 6448 | 717 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 718 | 6449 | 718 | | His | AiB | His | Gly | Thr | Phe | Thr | Ser | Asp | Tyr | Ser | Lys | Tyr | Leu | Asp | Ala | Lys | Arg | Ala | Arg | Glu | Phe | Ile | Glu | Trp | Leu | Leu | Gln | Ser |
| 719 | 6452 | 719 | | His | AiB | His | Gly | Thr | Phe | Thr | Ser | Asp | Tyr | Ser | Lys | Tyr | Leu | Asp | Ala | Lys | Arg | Ala | Arg | Glu | Phe | Ile | Glu | Trp | Leu | Leu | Gln | Ser |
| 720 | 6455 | 720 | Ex646Cl | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 721 | 6456 | 721 | Ex652Cl | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |
| 722 | 6459 | 722 | Dup Ex707 | His | AiB | His | Gly | Thr | Phe | Thr | Ser | Asp | Tyr | Ser | Lys | Tyr | Leu | Asp | Ala | Lys | Arg | Ala | Arg | Glu | Phe | Ile | Glu | Trp | Leu | Leu | Gln | Ser |
| 723 | 6462 | 723 | | His | AiB | His | Gly | Thr | Phe | Thr | Ser | Asp | Tyr | Ser | Lys | Tyr | Leu | Asp | Ala | Lys | Arg | Ala | Arg | Glu | Phe | Ile | Glu | Trp | Leu | Leu | Gln | Ser |
| 724 | 6475 | 724 | | His | AiB | His | Gly | Thr | Phe | Thr | Ser | Asp | Tyr | Ser | Lys | Tyr | Leu | Asp | Ala | Lys | Arg | Ala | His | Glu | Phe | Ile | Glu | Trp | Leu | Leu | Gln | Ser |
| 725 | 6483 | 725 | Dup Ex708 | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |

Figure 2 (Continued)

| 30 | 31 | 32 | 33 | 34 | 35 | 36 | 37 | 38 | 39 | 40 | 41 | 42 | 43 | 44 | 45 | 46 | 47 | 48 | Z | n (R=C$_n$) | Ex | n | potent | food |
|---|---|---|---|---|---|---|---|---|---|---|---|---|---|---|---|---|---|---|---|---|---|---|---|---|
| His | Gln | His | Gln | His | Glu | Ser | Pro | Gly | | | | | | | | | | | - | 18 | 686 | 2 | 7.0 | 7.0 |
| His | Gln | His | Gln | His | Glu | Ser | Gly | | | | | Lys | | | | | | | - | 18 | 687 | 1 | 3.0 | 3.0 |
| His | His | Gln | Gln | His | Glu | Gly | | | | | | Lys | | | | | | | - | 16 | 688 | 4 | 6.3 | 6.5 |
| His | His | Gln | Gln | His | Glu | Gly | | | | | | Lys | | | Thr | Gly | Ser | Gly | - | 16 | 689 | 2 | 7.0 | 7.0 |
| His | Gln | Gln | Gln | His | Glu | Ser | Pro | Gly | | | | Lys | | | | | | | - | 18 | 690 | 1 | 5.5 | 5.5 |
| His | Gln | Gln | Gln | His | Glu | Ser | Pro | Pro | Gly | | | Lys | | | | | | | - | 18 | 691 | 1 | 5.0 | 5.0 |
| His | Gln | Gln | Gln | Glu | Glu | Ser | Pro | Pro | Gly | | | Lys | | | | | | | - | 18 | 692 | | | |
| His | Gln | His | Gln | His | Ser | Pro | Pro | Pro | Gly | | | Lys | | | | | | Asn | - | 18 | 693 | | | |
| His | Gln | His | Gln | His | Glu | Ser | Ser | Ser | Gly | | | Lys | | | | | | | - | 20 | 694 | | | |
| His | His | Gln | Gln | His | Pro | Ser | Pro | Pro | | | | Lys | | | Thr | Gly | Ser | Gly | - | 18 | 695 | 1 | 3.0 | 3.0 |
| His | His | Gln | Gln | Glu | Ser | Pro | Pro | Ala | | | | Lys | | | | | | Asn | - | 16 | 696 | 1 | 3.5 | 3.5 |
| His | His | Gln | Gln | Glu | Ser | Pro | Pro | Pro | Gly | | | Lys | | | | | | | - | 20 | 697 | | | |
| His | Gln | Gln | Gln | Glu | Ser | Pro | Pro | Pro | Gly | | | Lys | | | | | Ser | Asn | - | 18 | 698 | 1 | 5 | 5.0 |
| His | Gln | Gln | Gln | Glu | Ser | Ser | Pro | Ala | Pro | | | Lys | | | | | | | - | 16 | 699 | 3 | 6.5 | 6.8 |
| His | Gln | Gln | Gln | His | Ser | Ser | Pro | Pro | Pro | Gly | | Lys | | | | | | Asn | - | 20 | 700 | 3 | 6.0 | 6.3 |
| His | Gln | Gln | Gln | His | Glu | Ser | Pro | Pro | | | | Lys | | | Thr | Gly | Ser | Gly | - | 18 | 701 | | | |
| His | Gln | Gln | Gln | Ser | Ser | Gly | Gly | Ala | | | | Lys | | | | | | | - | 16 | 702 | | | |
| Gln | Gln | Gln | Glu | Ser | Ser | Pro | Ala | | | | | Lys | | | | | | | - | 18 | 703 | | | |
| His | Gln | His | Gln | Glu | Ser | Pro | Pro | Pro | Gly | | | Lys | | | | | Ser | Asn | - | 18 | 704 | 5 | 7.0 | 7.6 |
| His | Gln | His | Gln | Pro | Pro | Ser | Ser | Pro | Gly | | | Lys | | | | | Ser | Asn | - | 18 | 705 | 5 | 7.2 | 6.6 |
| His | Gln | His | Gln | Pro | Pro | Ser | Ser | Ser | Gly | | | Lys | | | | | Ser | Asn | - | 18 | 706 | 4 | 7.3 | 7.3 |
| His | Gln | His | Gln | His | Pro | Ser | Ser | Ser | Ala | | | Lys | | | | | | Asn | - | 18 | 707 | 4 | 6.9 | 7.1 |
| His | Gln | His | Gln | Pro | Pro | Ser | Ser | Ala | Ala | | | Lys | | | | | | Asn | - | 18 | 708 | 5 | 7.8 | 7.2 |
| His | Gln | His | Gln | Pro | Pro | Ser | Ser | Ser | Ala | | | Lys | | | | | | Asn | - | 18 | 709 | 2 | 6.5 | 6.5 |
| His | Gln | His | Gln | His | Pro | Ser | Ser | Ser | Ala | | | Lys | | | | | Asn | His | - | 16 | 710 | 1 | 4 | 4.0 |
| His | Gln | His | Gln | His | Glu | Ser | Pro | Ser | Pro | | | Lys | | | | | | | - | 18 | 711 | 1 | 3 | 3.0 |
| His | Gln | His | Gln | His | Glu | Ser | Pro | Pro | Pro | | | Lys | | | Thr | Gly | Ser | Gly | - | 18 | 712 | 1 | 5 | 5.0 |
| His | Gln | Gln | Gln | Ser | Glu | Ser | Gly | | | | | Lys | | | | | | | - | 16 | 713 | | | |
| His | Gln | His | Gln | His | Glu | Gly | | | | | | Lys | | | Thr | Gly | Ser | Gly | - | 16 | 714 | 1 | 8 | 8.0 |
| His | Gln | His | Gln | His | Glu | Ser | Ser | | | | | Lys | | | Thr | Gly | Ser | Gly | - | 16 | 715 | 1 | 4 | 4.0 |
| His | Gln | His | Gln | Ser | Pro | Ser | Ser | | | | | Lys | | | Thr | Gly | Ser | Gly | - | 16 | 716 | 1 | 7 | 7.0 |
| His | Gln | His | Gln | Ser | Glu | Ser | Ser | Ser | Ala | | | Lys | | | | | | | - | 18 | 717 | | | |
| His | Gln | His | Gln | Ser | Ser | Ser | Ser | Ser | Ala | | | Lys | | | | | | | - | 18 | 718 | | | |
| His | Gln | His | Gln | Ser | Ser | Gly | Ser | Ser | Ala | | | Lys | | | | | | | - | 18 | 719 | | | |
| His | His | Gln | Gln | Ser | Pro | Ser | Pro | Pro | Pro | | | Lys | | | | | | Asn | - | 16 | 720 | | | |
| His | His | Gln | Gln | Ser | Pro | Ser | Pro | Pro | Gly | | | Lys | | | | | | Asn | - | 18 | 721 | | | |
| His | His | Gln | Gln | Pro | Pro | Ser | Pro | Pro | Ala | | | Lys | | | | | | | - | 18 | 722 | | | |
| His | Gln | Gln | Gln | Ser | Ser | Gly | Gly | Pro | Pro | Gly | | Lys | | | Thr | Gly | Ser | Gly | - | 16 | 723 | | | |
| His | Gln | Gln | Gln | Pro | Ser | Ser | Gly | Ala | Pro | | Gly | Lys | | | | | | | - | 18 | 724 | 1 | 8 | 7.0 |
| His | Gln | His | Gln | Pro | Ser | Ser | Ser | Ala | | | | Lys | | | | | | Asn | - | 18 | 725 | 1 | 8 | 8.0 |

Figure 2 (Continued)

| Ex | G ref | SEQ ID | Note | 1 | 2 | 3 | 4 | 5 | 6 | 7 | 8 | 9 | 10 | 11 | 12 | 13 | 14 | 15 | 16 | 17 | 18 | 19 | 20 | 21 | 22 | 23 | 24 | 25 | 26 | 27 | 28 | 29 |
|---|---|---|---|---|---|---|---|---|---|---|---|---|---|---|---|---|---|---|---|---|---|---|---|---|---|---|---|---|---|---|---|---|
| 726 | 6486 | 726 | | His | AiB | His | Gly | Thr | Phe | Thr | Ser | Asp | Tyr | Ser | Lys | Tyr | Leu | Asp | Ala | Lys | Arg | Ala | Arg | Glu | Phe | Ile | Glu | Trp | Leu | Leu | Gln | Ser |
| 727 | 6562 | 727 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Lys | Gln | Ser |
| 728 | 6563 | 728 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Lys | Gln | Ser |
| 729 | 6564 | 729 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Lys | Gln | Ser |
| 730 | 6565 | 730 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Lys | Gln | Gly |
| 731 | 6566 | 731 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Lys | Gln | Gly |
| 732 | 6567 | 732 | | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Lys | Gln | Gly |
| 733 | 6583 | 733 | | His | AiB | His | Gly | Thr | Phe | Thr | Ser | Asp | Leu | Ser | Lys | Gln | Leu | Glu | Glu | Lys | Arg | Ala | Arg | Leu | Phe | Ile | Glu | Trp | Leu | Lys | Gln | Gly |
| 734 | 6588 | 734 | Dup Ex706 | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Lys | Gln | Gly |
| 735 | 6592 | 735 | | His | AiB | His | Gly | Thr | Phe | Thr | Ser | Asp | Tyr | Ser | Lys | Tyr | Leu | Glu | Glu | Lys | Arg | Ala | Gln | Glu | Phe | Ile | Glu | Trp | Leu | Lys | Gln | Gly |
| 736 | 6593 | 736 | | His | AiB | His | Gly | Thr | Phe | Thr | Ser | Asp | Tyr | Ser | Lys | Tyr | Leu | Glu | Glu | Lys | Arg | Ala | Gln | Glu | Phe | Ile | Glu | Trp | Leu | Lys | Gln | Gly |
| 737 | 6594 | 737 | Dup Ex640 | His | AiB | His | Gly | Thr | Phe | Thr | Ser | Asp | Tyr | Ser | Lys | Tyr | Leu | Asp | Ala | Lys | Arg | Ala | Gln | Glu | Phe | Ile | Glu | Trp | Leu | Leu | Gln | Ser |

Figure 2 (Continued)

| 30 | 31 | 32 | 33 | 34 | 35 | 36 | 37 | 38 | 39 | 40 | 41 | 42 | 43 | 44 | 45 | 46 | 47 | 48 | Z | n (R=$C_n$) | Ex | n | potent | food |
|---|---|---|---|---|---|---|---|---|---|---|---|---|---|---|---|---|---|---|---|---|---|---|---|---|
| His | Gln | Gln | His | Pro | Ser | Ser | Ser | Ala |  |  |  | Lys |  |  |  |  |  | Asn | i | 18 | 726 | 1 | 4 | 4.0 |
| His | Gln | Gln | His | Glu | Ser | Ser | Gly | Ala | Pro | Pro | Gly | Lys |  |  |  |  |  |  | i | 18 | 727 |  | 1 |  |
| His | Gln | His | Gln | His | Glu | Ser | Pro | Pro | Pro | Gly |  | Lys |  |  |  |  | Asn | His | i | 16 | 728 |  | 2 |  |
| His | Gln | Gln | His | His | Glu | Ser | Gly |  |  |  |  | Lys |  |  | Thr | Gly | Ser | Gly | i | 16 | 729 |  | 0 | 9.1 |
| His | Gln | Gln | His | Glu | Ser | Ser | Gly | Ala | Pro | Pro | Gly | Lys |  |  |  |  |  |  | i | 18 | 730 |  | -1 | 1.5 |
| His | Gln | His | Gln | His | Glu | Ser | Pro | Pro | Pro | Gly |  | Lys |  |  |  |  | Asn | His | i | 16 | 731 |  | -1 | 3.1 |
| His | Gln | His | Gln | His | Glu | Ser | Gly |  |  |  |  | Lys |  |  | Thr | Gly | Ser | Gly | i | 16 | 732 |  | 1 |  |
| Gly | Pro | Ser | His | Gly | His | Pro | Pro | Pro | Pro | Gly |  | Lys |  |  |  |  |  |  | i | 18 | 733 |  | 6 | 1.4 |
| His | Gln | Gln | His | Pro | Ser | Pro | Pro | Pro | Pro | Gly |  | Lys |  |  |  |  |  | Asn | i | 18 | 734 |  |  |  |
| Gly | Pro | His | Gln | His | Glu | Ser | Pro | Pro | Pro | Gly |  | Lys |  |  |  |  | Asn | His | i | 16 | 735 |  | 1 | 1.6 |
| Gly | Pro | Gln | His | Pro | Ser | Ser | Pro | Pro | Pro | Gly |  | Lys |  |  |  |  | Asn | Asn | i | 18 | 736 |  | -3 |  |
| His | Gln | His | Gln | His | Glu | Ser | Pro | Pro | Pro | Gly |  | Lys |  |  |  |  | Asn | His | i | 16 | 737 |  |  |  |

PEPTIDE HORMONE ANALOGUES

CROSS-REFERENCE TO RELATED APPLICATIONS

This application is the National Stage of International Application No. PCT/GB2020/051425, filed on Jun. 12, 2020, which claims the benefit of and priority to Great Britain Patent Application No. 1908424.3, filed on Jun. 12, 2019, the contents of which are incorporated by reference in their entirety.

SEQUENCE LISTING

The instant application contains a Sequence Listing which has been submitted via EFS-Web and is hereby incorporated by reference in its entirety. Said ASCII copy, created on Dec. 10, 2021, is named 50868US_CRF_sequencelisting.txt, and is 535,357 bytes in size.

FIELD

The present disclosure relates to compounds which are peptide hormone analogues, and which are useful in treating disorders such as diabetes and obesity.

BACKGROUND

According to the National Health and Nutrition Examination Survey (NHANES, 2009-2010), 33.0% of adults in the United States aged 20 and over are overweight, 35.7% are obese, and 6.3% are extremely obese. In addition, a large percentage of children in the United States are overweight or obese.

The cause of obesity is complex and multi-factorial. Increasing evidence suggests that obesity is not a simple problem of self-control but is a complex disorder involving appetite regulation and energy metabolism. Although the etiology of obesity is not definitively established, genetic, metabolic, biochemical, cultural and psychosocial factors are believed to contribute. In general, obesity has been described as a condition in which excess body fat puts an individual at a health risk.

There is strong evidence that obesity is associated with increased morbidity and mortality. Disease risk, such as cardiovascular disease risk and type 2 diabetes disease risk, increases independently with increased body mass index (BMI). Indeed, this risk has been quantified as a five percent increase in the risk of cardiac disease for females, and a seven percent increase in the risk of cardiac disease for males, for each point of a BMI greater than 24.9 (see Kenchaiah et al., *N. Engl. J. Med.* 347:305, 2002; Massie, *N. Engl. J. Med.* 347:358, 2002).

Diabetes is a chronic syndrome of impaired carbohydrate, protein, and fat metabolism owing to insufficient secretion of insulin or to target tissue insulin resistance. It occurs in two major forms: insulin-dependent diabetes mellitus (type 1 diabetes) and non-insulin dependent diabetes mellitus (type 2 diabetes). Diabetes type I, or insulin dependent diabetes mellitus (IDDM) is caused by the destruction of β cells, which results in insufficient levels of endogenous insulin. Diabetes type 2, or non-insulin dependent diabetes, results from a defect in both the body's sensitivity to insulin, and a relative deficiency in insulin production. According to the National Diabetes Statistics Report, 2014 around 28.9 million adults in the United States aged 20 and over have diabetes (2009-2012 National Health and Nutrition Examination Survey estimates applied to 2012 U.S. Census data). In adults 90 to 95% of the diabetes is type 2 diabetes.

There is substantial evidence that weight loss in obese persons reduces important disease risk factors. Even a small weight loss, such as 10% of the initial body weight in both overweight and obese adults has been associated with a decrease in risk factors such as hypertension, hyperlipidemia, and hyperglycemia. It has been shown that considerable weight loss can effectively cure type 2 diabetes (Lim et al, Diabetologia June 2011).

Although diet and exercise provide a simple method to decrease weight gain, overweight and obese individuals often cannot sufficiently control these factors to effectively lose weight. Pharmacotherapy is available; several weight loss drugs have been approved by the Food and Drug Administration that can be used as part of a comprehensive weight loss program. However, many of these drugs have proven to have serious adverse side effects, and have had to be withdrawn. When less invasive methods have failed, and the patient is at high risk for obesity related morbidity or mortality, weight loss surgery is an option in carefully selected patients with clinically severe obesity. However, these treatments are high-risk, and suitable for use in only a limited number of patients. It is not only obese subjects who wish to lose weight. People with weight within the recommended range, for example in the upper part of the recommended range, may wish to reduce their weight, to bring it closer to their ideal weight. Thus, a need remains for agents that can be used to effect weight loss in overweight and obese subjects as well as subjects who are of normal weight.

A number of approaches to the development of agents useful in effecting weight loss have involved gastrointestinal peptide hormones and their analogues. For example, derivatives of peptides deriving from the preproglucagon molecule have been proposed for use in treatment of obesity and/or diabetes. Preproglucagon is a precursor peptide of glucagon, as well as other hormones including glucagon-like peptide 1 (GLP-1). Glucagon is released in vivo when blood glucose levels fall low and has the activity of causing the liver to convert stored glycogen into glucose which is released into the bloodstream raising blood glucose levels. GLP-1 is produced in vivo in the intestinal L cell in response to the presence of nutrients in the lumen of the gut. GLP-1 possesses a number of physiological functions including increasing insulin secretion from the pancreas in a glucose-dependent manner, decreasing glucagon secretion from the pancreas, inhibiting gastric emptying and decreasing food intake by increasing satiety. Increased insulin secretion leads to a decrease in circulating glucose concentration.

Examples of research into analogues of such peptides are described in, for example, WO2013/004983 which describes peptide molecules containing sequence from both the GLP-1 and glucagon peptides. WO2015/132599 also discloses peptide hormone analogues, which are derivable from preproglucagon and which are useful in the therapy of disorders such as obesity and diabetes. WO2017/178829 discloses compounds that are analogues of exendin-4, GLP-1 and oxyntomodulin which have a modified ligand bias and therapeutically useful characteristics. Another example is the peptide liraglutide, a GLP-1 agonist which has the sequence of GLP-1(7-37) with an arginine residue substituted for the native lysine at position 34, and with the sidechain of the lysine residue at position 26 being acylated by a hexadecanoyl group (palmitic acid) attached to the lysine though a glutamic acid spacer. Liraglutide has been developed for use as an injectable drug for the treatment of type II diabetes.

However, despite significant advances, the process of identifying substances useful as drugs remains a complex and, in many cases, unpredictable field. In order to be useful as therapeutic agents, compounds must possess a suitable range of properties. In addition to having good efficacy at the biological target of interest, compounds must have good in vivo pharmacokinetic properties, low toxicity and an acceptable side effect profile. For example, even with commercial agents such as liraglutide, side effects can include nausea and vomiting, and concerns have also been raised with regard to thyroid cancer and pancreatitis.

Thus, there remains a need for further compounds which are useful for the treatment of disorders and diseases such as diabetes and obesity. For example, it would be desirable to identify peptides having beneficial properties such as an improved activity profile, and/or which have reduced side effects. For example, it would be desirable for a peptide to be identified that increases energy expenditure in a subject, but does not significantly reduce food intake. If a compound decreases food intake less, then it is expected that the compound will have fewer side effects such as nausea. Alternatively, or additionally, it would be desirable for a peptide to be identified that has these and other biological effects for a sustained period. A compound that has a longer period of activity can be administered less frequently and at lower dose, which contributes to improved convenience for the subject, to fewer side effects and to lower cost.

SUMMARY

In a first aspect there is provided a compound of Formula (I):

X-W-Y1-Y2                    Formula (I)

Wherein
  X is an amino acid sequence:

```
                                                   [SEQ ID NO: 742]
His1-Xaa2-Xaa3-Gly4-Thr5-Phe6-Thr7-Ser8-Asp9-

Xaa10-Ser11-Xaa12-Xaa13-Leu14-Xaa15-Xaa16-Xaa17-

Xaa18-Xaa19-Xaa20-Xaa21-Phe22-Xaa23-Xaa24-Trp25-

Leu26-Xaa27-Xaa28-Xaa29-
``` wherein
  Xaa2 is AIB or Ser;
  Xaa3 is His, Glu, Gln, Asp or Phe;
  Xaa10 is Leu, Tyr or Val;
  Xaa12 is Arg, Lys or His;
  Xaa13 is Tyr, Gln or His;
  Xaa15 is Asp or Glu;
  Xaa16 is Ala, Gln, Glu, Ser, His or Thr;
  Xaa17 is Arg, Glu, His or Lys;
  Xaa18 is Ala, Arg or Lys;
  Xaa19 is Ala or Val;
  Xaa20 is Arg, Gln or His;
  Xaa21 is Asp, Leu, His or Glu;
  Xaa23 is Ile or Val;
  Xaa24 is Gln or Glu;
  Xaa27 is Asn, Leu or Lys;
  Xaa28 is Ala, Asn, Gln, Gly, His, Thr, Leu, Ser, or Ile; and
  Xaa29 is Gly, His, Ser or Thr;

W is an amino acid sequence:

```
                                                   [SEQ ID NO: 743]
        -His30-His31-His32-His33-His34-;
``` wherein optionally up to four of the five His residues may each independently be replaced by an amino acid selected from Gly, Ala, Glu, Gln, Pro and Ser, and at least three of the five residues in W are selected from His and Gln.
Y1 is an amino acid sequence:

```
                                                   [SEQ ID NO: 744]
-Xaa35-Xaa36-Xaa37-Xaa38-Xaa39-Xaa40-Xaa41-Lys42-
Xaa43-Xaa44
``` wherein
  Xaa35 is Pro, His, Glu, Ser or Ala;
  Xaa36 is Ser, Gly, Pro or Thr;
  Xaa37 is Pro, Ala, Ser, Glu, Gly or absent;
  Xaa38 is Pro, Ala, Gly, Ser or absent;
  Xaa39 is Pro, Gly, Ala, Ser or absent;
  Xaa40 is Pro, Gly, Ser or absent;
  Xaa41 is Gly, Ser or absent
  Xaa43 is Ser or absent;
  Xaa44 is Trp or absent;
And the lysine residue at position 42 is substituted at its ε-amino group with a group Y2 and Y2 is:

```
                                                   [SEQ ID NO: 745]
            Z-Xaa45-Xaa46-Xaa47-Xaa48-
```

Wherein:
  Xaa45 is Ser, Gly, Thr or absent
  Xaa46 is Ser, Gly, Thr or absent
  Xaa47 is Gly, Asn, Ser, Gln, Thr, His, Tyr, Ala or absent;
  Xaa48 is Ser; Thr, His, Gln, Gly, Asn or absent;
  and Z is a group of formula:

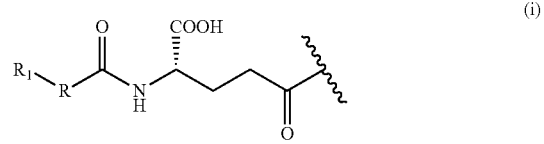

(i)

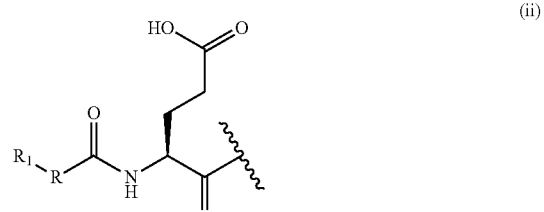

(ii)

or

(iii)

wherein R is a $C_8$-$C_{28}$ alkylene or alkenylene group and $R^1$ is $CO_2H$.

The compound can optionally be a derivative, salt or solvate as defined herein.

It has surprisingly been found that the compounds of the invention possess excellent biological properties. For example, the compounds possess a tailored profile with regards to potency properties at the glucagon and GLP-1 receptors. With regard to in vivo properties, administration of example peptides of the invention to rats has been shown to result in increased weight loss. Example compounds have also been shown to achieve these effects without or only minimally reducing the amount of food ingested, indicating that the compounds are particularly effective at improving metabolism. Rodents are not able to vomit, but rodents which are experiencing nausea are likely to be put off from consuming food. The absence of reduction in the levels of food ingested suggests that the rodents did not experience nausea after receiving a compound of the invention. Thus, the absence of a reduction in the levels of food ingested in in vivo experiments (or at least a lower reduction in the level of food ingested than the level of the weight loss) further supports that the compounds of the invention have an improved side effect profile. In addition, compounds of the invention enhance insulin release.

Compared with GLP-1 and analogues and derivatives of GLP-1 that have gone before, the compounds of the invention are extended at the C-terminus with particular residues, including that there is a lysine residue at position 42 and including that that lysine residue is functionalised in a particular way, to include the group R—$R^1$ where $R^1$ is $CO_2H$. These are functionalisations that have not previously been investigated and the beneficial properties found by the current inventors have not previously been seen.

Also provided herein is a composition comprising a compound, derivative or salt as defined herein together with a pharmaceutically acceptable carrier and optionally a further therapeutic agent.

Also provided herein is a compound, derivative or salt as defined herein, or a composition comprising such a compound, derivative or salt and a pharmaceutically acceptable carrier, for use as a medicament, e.g. for use in the prevention or treatment of diabetes, obesity, heart disease, stroke or non-alcoholic fatty liver disease, for increasing the energy expenditure of a subject, improving insulin release in a subject, improving carbohydrate metabolism in a subject, improving the lipid profile of a subject, improving carbohydrate tolerance in a subject, reducing appetite, reducing food intake, reducing calorie intake, and/or for use as a cytoprotective agent.

Also provided herein is a method of treating or preventing a disease or disorder or other non-desired physiological state in a subject comprising administration of a therapeutically effective amount of a compound, derivative or salt as defined herein, or of a composition comprising such a compound, derivative or salt and a pharmaceutically acceptable carrier, e.g. in a method of treating or preventing diabetes, obesity, heart disease, stroke or non-alcoholic fatty liver disease in a subject, for increasing energy expenditure in a subject, improving insulin release in a subject, improving carbohydrate metabolism in a subject, improving the lipid profile of a subject, improving carbohydrate tolerance in a subject, reducing appetite, reducing food intake, reducing calorie intake, and/or providing cytoprotection in a subject.

Also provided herein is a use of a compound, derivative or salt as defined herein for the manufacture of a medicament for the prevention or treatment of diabetes, obesity, heart disease, stroke or non-alcoholic fatty liver disease, increasing the energy expenditure of a subject, improving insulin release in a subject, improving carbohydrate metabolism in a subject, improving the lipid profile of a subject, improving carbohydrate tolerance in a subject, reducing appetite, reducing food intake, reducing calorie intake, and/ or for use as a cytoprotective agent.

Also provided herein is a method of causing weight loss or preventing weight gain in a subject for cosmetic purposes comprising administration of an effective amount of a compound, derivative, salt or composition as defined herein.

BRIEF DESCRIPTION OF THE DRAWINGS

FIG. 1 shows the amino acid sequences of example compounds of the invention. The compounds are presented with the N-terminal residue at the left-hand side of the Table (signified by the column titled "1"). The amino acid sequence for each compound is set out over two horizontal pages. Results of feeding and receptor binding experiments are shown in the far right hand columns.

FIG. 2 shows the amino acid sequences of further example compounds of the invention. The compounds are presented with the N-terminal residue at the left-hand side of the Table (signified by the column titled "1"). The amino acid sequence for each compound is set out over two horizontal pages. Results of feeding experiments are shown in the far right hand columns.

SEQUENCE LISTING

This application is accompanied by a machine-readable sequence listing. In certain embodiments, the invention encompasses the sequences of the sequence listing, peptides comprising or consisting of those sequences and all related uses, methods and products described therein.

The amino acid sequences herein are shown with the N-terminus to the left, and where sequences are set out across multiple lines, the N-terminus is to the top left. Unless indicated otherwise, the amino acid residues in the sequences are L-amino acids.

The amino acid sequences listed in the application are shown using standard letter abbreviations for amino acids. The unnatural amino acid 2-aminoisobutyric acid has its usual abbreviation 'AIB'.

The specific sequences given herein relate to specific embodiments of the invention.

DETAILED DESCRIPTION

Definitions

In order to facilitate review of the various embodiments of this disclosure, the following explanations of specific terms are provided:

Animal: Living multi-cellular vertebrate organisms, a category that includes, for example, mammals and birds. The term mammal includes both human and non-human mammals. Similarly, the term "subject" includes both human and veterinary subjects. In preferred embodiments of the invention, the subject is a human subject.

Appetite: A natural desire, or longing for food. In one embodiment, appetite is measured by a survey to assess the desire for food. Increased appetite generally leads to increased feeding behaviour.

Appetite Suppressants: Compounds that decrease the desire for food. Commercially available appetite suppressants include, but are not limited to, amfepramone (diethylpropion), phentermine, mazindol and phenylpropanolamine fenfluramine, dexfenfluramine, and fluoxetine.

Body Mass Index (BMI): A mathematical formula for measuring body mass, also sometimes called Quetelet's Index. BMI is calculated by dividing weight (in kg) by height$^2$ (in meters$^2$). The current standards for both men and women accepted as "normal" are a BMI of 20-24.9 kg/m$^2$. In one embodiment, a BMI of greater than 25 kg/m$^2$ can be used to identify an obese subject. Grade I obesity (which is sometimes referred to as being "overweight" rather than obesity) corresponds to a BMI of 25-29.9 kg/m$^2$. Grade II obesity corresponds to a BMI of 30-40 kg/m$^2$; and Grade III obesity corresponds to a BMI greater than 40 kg/m$^2$ (Jequier, *Am. J Clin. Nutr.* 45:1035-47, 1987). Ideal body weight will vary among species and individuals based on height, body build, bone structure, and sex.

Cardioprotection refers to the protection of cardiac cells (and especially the myocardial cells) from apoptosis, necrotic cell death or degeneration (loss of function). Cardioprotection is most often required following myocardial infarction, but may also be used in subjects suffering from ischemic heart disease (for example angina)

Cytoprotection refers to the protection of cells from apoptosis, necrotic cell death or degeneration (loss of function).

Diabetes: A failure of cells to transport endogenous glucose across their membranes either because of an endogenous deficiency of insulin and/or a defect in insulin sensitivity. Diabetes is a chronic syndrome of impaired carbohydrate, protein, and fat metabolism owing to insufficient secretion of insulin or to target tissue insulin resistance. It occurs in two major forms: insulin-dependent diabetes mellitus (IDDM, type I) and non-insulin dependent diabetes mellitus (NIDDM, type II) which differ in etiology, pathology, genetics, age of onset, and treatment.

The two major forms of diabetes are both characterized by an inability to deliver insulin in an amount and with the precise timing that is needed for control of glucose homeostasis. Diabetes type 1, or insulin dependent diabetes mellitus (IDDM) is caused by the destruction of R cells, which results in insufficient levels of endogenous insulin. Diabetes type II, or non-insulin dependent diabetes, results from a defect in both the body's sensitivity to insulin, and a relative deficiency in insulin production.

Energy Metabolism: The body has to expend a certain amount of energy to maintain normal metabolism. In civilized man this is often set at about 2,800 Calories daily. If food consumption does not provide this, weight loss results. However, energy metabolism is also regulated, and, for example, administration of glucagon is thought to increase the metabolic rate so that a greater food intake is required to achieve energy balance and maintain weight. Thus, if food intake is maintained at the usual level, but energy metabolism is increased, weight loss will result.

Food intake: The amount of food consumed by an individual. Food intake can be measured by volume or by weight. For example, food intake may be the total amount of food consumed by an individual. Or, food intake may be the amount of proteins, fat, carbohydrates, cholesterol, vitamins, minerals, or any other food component, of the individual. "Protein intake" refers to the amount of protein consumed by an individual. Similarly, "fat intake," "carbohydrate intake," "cholesterol intake," "vitamin intake," and "mineral intake" refer to the amount of proteins, fat, carbohydrates, cholesterol, vitamins, or minerals consumed by an individual.

GLP-1: Glucagon-like peptide 1 (GLP-1) is derived from the transcription product of the proglucagon gene. The biologically active forms of GLP-1 are truncated forms known as GLP-1$_{(7-37)}$ and GLP-1$_{(7-36)}$-NH$_2$ (the designation —NH$_2$ designates an amino acid sequence in which the C-terminal amino acid has a —C(O)NH$_2$ group in place of a carboxylic acid group).

The sequence of human GLP-1$_{(7-37)}$ is His-Ala-Glu-Gly-Thr-Phe-Thr-Ser-Asp-Val-Ser-Ser-Tyr-Leu-Glu-Gly-Gln-Ala-Ala-Lys-Glu-Phe-Ile-Ala-Trp-Leu-Val-Lys-Gly-Arg-Gly. [SEQ ID NO: 746]

The sequence of human GLP-1$_{(7-36)}$-NH$_2$ is His-Ala-Glu-Gly-Thr-Phe-Thr-Ser-Asp-Val-Ser-Ser-Tyr-Leu-Glu-Gly-Gln-Ala-Ala-Lys-Glu-Phe-Ile-Ala-Trp-Leu-Val-Lys-Gly-Arg-CONH$_2$. [SEQ ID NO: 747]

Glucagon: Glucagon is a peptide derived from the proglucagon gene. It is a 29-amino acid polypeptide in humans and has the sequence:

[SEQ ID NO: 748]
His-Ser-Gln-Gly-Thr-Phe-Thr-Ser-Asp-Tyr-Ser-Lys-Tyr-Leu-Asp-Ser-Arg-Arg-Ala-Gln-Asp-Phe-Val-Gln-Trp-Leu-Met-Asn-Thr.

Neuroprotection refers to the protection of neurons within the nervous system (preferably within the central nervous system) from apoptosis, necrotic cell death or degeneration (loss of function). Neuroprotective treatments, including those relating to various aspects of the present invention may be required following a brain injury (for example those following physical trauma or non-traumatic injury such as stroke, brain tumours, infection, poisoning, hypoxia, ischemia, encephalopathy or substance abuse). Neuroprotective treatments, including those relating to various aspects of the present invention may also be indicated in subjects having a chronic neurodegenerative disease such as Alzheimer's disease, Parkinson's disease, Gehrig's disease or Huntington's disease.

Normal Daily Diet: The average food intake for an individual of a given species. A normal daily diet can be expressed in terms of caloric intake, protein intake, carbohydrate intake, and/or fat intake. A normal daily diet in humans generally comprises the following: about 2,000, about 2,400, or about 2,800 to significantly more calories. In addition, a normal daily diet in humans generally includes about 12 g to about 45 g of protein, about 120 g to about 610 g of carbohydrate, and about 11 g to about 90 g of fat. A low calorie diet would be no more than about 85%, and preferably no more than about 70%, of the normal caloric intake of a human individual.

In animals, the caloric and nutrient requirements vary depending on the species and size of the animal. For example, in cats, the total caloric intake per pound, as well as the percent distribution of protein, carbohydrate and fat varies with the age of the cat and the reproductive state. A general guideline for cats, however, is 40 cal/lb/day (18.2 cal/kg/day). About 30% to about 40% should be protein, about 7% to about 10% should be from carbohydrate, and about 50% to about 62.5% should be derived from fat intake. One of skill in the art can readily identify the normal daily diet of an individual of any species.

Obesity: A condition in which excess body fat may put a person at health risk (see Barlow and Dietz, *Pediatrics* 102:E29, 1998; National Institutes of Health, National Heart, Lung, and Blood Institute (NHLBI), *Obes. Res.* 6 (suppl. 2):51S-209S, 1998).

Excess body fat is a result of an imbalance of energy intake and energy expenditure. For example, the Body Mass Index (BMI) may be used to assess obesity. In one commonly used convention, a BMI of 25.0 kg/m² to 29.9 kg/m² is overweight, while a BMI of 30 kg/m² or greater is obese.

In another convention, waist circumference is used to assess obesity. In this convention, in men a waist circumference of 102 cm or more is considered obese, while in women a waist circumference of 89 cm or more is considered obese. Strong evidence shows that obesity affects both the morbidity and mortality of individuals. For example, an obese individual is at increased risk for heart disease, non-insulin dependent (type 2) diabetes, hypertension, stroke, cancer (e.g. endometrial, breast, prostate, and colon cancer), dyslipidemia, gall bladder disease, sleep apnea, reduced fertility, and osteoarthritis, amongst others (see Lyznicki et al., *Am. Fam. Phys.* 63:2185, 2001).

Overweight: An individual who weighs more than their ideal body weight. An overweight individual can be obese but is not necessarily obese. For example, an overweight individual is any individual who desires to decrease their weight. In one convention, an overweight individual is an individual with a BMI of 25.0 kg/m² to 29.9 kg/m².

Oxyntomodulin (OXM): Oxyntomodulin is a 37 amino acid peptide member of the glucagon superfamily comprising the entire 29 amino acid sequence of glucagon, with an eight amino acid carboxy terminal extension, resulting from the tissue-specific processing of the pre-pro-glucagon precursor in the brain and gut. The human OXM sequence is as follows:

```
                                          [SEQ ID NO: 749]
His-Ser-Gln-Gly-Thr-Phe-Thr-Ser-Asp-Tyr-Ser-Lys-

Tyr-Leu-Asp-Ser-Arg-Arg-Ala-Gln-Asp-Phe-Val-Gln-

Trp-Leu-Met-Asn-Thr-Lys-Arg-Asn-Arg-Asn-Asn-Ile-

Ala.
```

PEGylation and PEGylated: PEGylation refers to the process of reacting a poly(alkylene glycol), preferably an activated poly(alkylene glycol) to form a covalent bond. A facilitator may be used, for example an amino acid, e.g. lysine. Although "PEGylation" is often carried out using poly(ethylene glycol) or derivatives thereof, such as methoxy poly(ethylene glycol), the term is not limited herein to the use of methoxy poly(ethylene glycol) but also includes the use of any other useful poly(alkylene glycol), for example poly(propylene glycol). The term PEGylated refers to a compound containing such a poly(alkylene glycol) group.

pI: pI is an abbreviation for isoelectric point. An alternative abbreviation sometimes used is IEP. It is the pH at which a particular molecule carries no net electric charge. At a pH below its pI a protein or peptide carries a net positive charge. At a pH above its pI a protein or peptide carries a net negative charge. Proteins and peptides can be separated according to their isoelectric points using a technique called isoelectric focusing which is an electrophoretic method that utilises a pH gradient contained within a polyacrylamide gel.

Peripheral Administration: Administration outside of the central nervous system. Peripheral administration does not include direct administration to the brain. Peripheral administration includes, but is not limited to intravascular, intramuscular, subcutaneous, inhalation, oral, rectal, transdermal or intra-nasal administration.

Polypeptide: A polymer in which the monomers are amino acid residues which are joined together through amide bonds. Unless dictated otherwise by context, the terms "polypeptide", "peptide", or "protein" as used herein encompass any amino acid sequence and include modified sequences such as glycoproteins. The term "polypeptide" covers naturally occurring proteins, as well as those which are recombinantly or synthetically produced. The term "polypeptide fragment" refers to a portion of a polypeptide, for example a fragment which exhibits at least one useful sequence in binding a receptor. The term "functional fragments of a polypeptide" refers to all fragments of a polypeptide that retain an activity of the polypeptide. Biologically functional peptides can also include fusion proteins, in which the peptide of interest has been fused to another peptide that does not decrease its desired activity.

Subcutaneous administration: Subcutaneous administration is administration of a substance to the subcutaneous layer of fat which is found between the dermis of the skin and the underlying tissue. Subcutaneous administration may be by an injection using a hypodermic needle fitted, for example, to a syringe or a "pen" type injection device. Other administration methods may be used for example microneedles. Injection with a hypodermic needle typically involves a degree of pain on behalf of the recipient. Such pain may be masked by use of a local anaesthetic or analgesic. However, the usual method used to reduce the perceived pain of injections is to merely distract the subject immediately prior to and during the injection. Pain may be minimised by using a relatively small gauge hypodermic needle, by injecting a relatively small volume of substance and by avoiding excessively acidic or alkali compositions which may cause the subject to experience a "stinging" sensation at the injection site. Compositions having a pH of between pH 4 and pH 10 are usually regarded as tolerably comfortable.

Therapeutically effective amount: A dose sufficient to prevent advancement, or to cause regression of a disorder, or which is capable of relieving a sign or symptom of a disorder, or which is capable of achieving a desired result. In some embodiments, a therapeutically effective amount of a compound of the invention is an amount sufficient to inhibit or halt weight gain, or an amount sufficient to decrease appetite, or an amount sufficient to increase energy expenditure.

Compounds of the Invention

The present inventors have found that example compounds of the invention have properties including increasing weight loss in vivo whilst not reducing food intake (or reducing food intake by less than the level of the weight loss).

Compared with GLP-1 and derivatives of GLP-1 that have gone before, the compounds of the invention are extended at the C-terminus with particular residues, including that there is a lysine residue at position 42 and including that that lysine residue is functionalised in a particular way, to include the group R—R¹ where R¹ is CO₂H. These are functionalisations that have not previously been investigated and the beneficial properties found by the current inventors have not previously been seen.

As described above, compounds of the invention have Formula (I): X—W-Y1-Y2. Within the X portion of the molecule, it is preferred that:

Xaa2 is AIB;
Xaa3 is His, Gln or Glu;
Xaa10 is Leu or Tyr;
Xaa12 is Arg or Lys;
Xaa13 is Tyr or Gln;
Xaa15 is Asp or Glu;
Xaa16 is Ala, Gln, Glu or Ser;
Xaa17 is Arg, Glu or Lys;

Xaa18 is Ala, Arg or Lys;
Xaa19 is Ala or Val;
Xaa20 is Arg, Gln or His;
Xaa21 is Asp, Glu or Leu;
Xaa23 is Ile or Val;
Xaa24 is Gln or Glu;
Xaa27 is Leu or Lys;
Xaa28 is Ala, Asn, Gln or His; and
Xaa29 is Gly, Ser or Thr;

Within the X portion of the molecule, in an embodiment, it is preferred that:
Xaa2 is AIB
Xaa3 is His, Gln or Glu;
Xaa10 is Tyr;
Xaa12 is Arg or Lys;
Xaa13 is Tyr;
Xaa15 is Asp;
Xaa16 is Ala, Gln, Glu or Ser;
Xaa17 is Arg or Lys;
Xaa18 is Arg or Lys;
Xaa19 is Ala;
Xaa20 is Gln or His;
Xaa21 is Glu or Asp;
Xaa23 is Ile or Val;
Xaa24 is Glu or Gln;
Xaa27 is Leu;
Xaa28 is Ala, Asn, Gln, His, Thr; and
Xaa29 is Gly, Ser or Thr.

In particular, it is preferred that:
Xaa2 is AIB
Xaa3 is His, Gln or Glu;
Xaa10 is Tyr;
Xaa12 is Arg or Lys;
Xaa13 is Tyr;
Xaa15 is Asp;
Xaa16 is Ala, Gln or Ser;
Xaa17 is Arg or Lys;
Xaa18 is Arg or Lys;
Xaa19 is Ala;
Xaa20 is Gln or His;
Xaa21 is Glu or Asp;
Xaa23 is Ile or Val;
Xaa24 is Glu or Gln;
Xaa27 is Leu;
Xaa28 is Ala, Asn, Gln or His; and
Xaa29 is Gly, Ser or Thr.

Considering the residues in turn, Xaa2 is selected from AIB and Ser. Preferably, Xaa2 is AIB.

Xaa3 is selected from His, Glu, Gln, Asp and Phe. Preferably, Xaa3 is His, Gln or Glu, for example Xaa3 is His. Alternatively, Xaa3 may be Glu.

Xaa10 is selected from Leu, Tyr and Val. Preferably, Xaa10 is Tyr.

Xaa12 is selected from Arg, Lys and His. Preferably, Xaa12 is Arg or Lys, for example Xaa12 is Arg. For example Xaa12 is Lys.

Xaa13 is selected from Tyr, Gln and His. Preferably, Xaa13 is Tyr.

Xaa15 is selected from Asp and Glu. Preferably, Xaa15 is Asp.

Xaa16 is selected from Ala, Gln, Glu, Ser, His and Thr. Preferably, Xaa16 is Ala, Gln, Glu or Ser. Xaa16 may be Ala, Gln or Glu. For example Xaa16 is Ala, Gln or Ser; for example Xaa16 is Ala or Gln, in particular Ala.

Xaa17 is selected from Arg, Glu, His and Lys. Preferably, Xaa17 is Arg or Lys, for example Xaa17 is Arg. For example Xaa17 is Lys.

Xaa18 is selected from Ala, Arg and Lys. Preferably, Xaa18 is Arg or Lys for example Xaa18 is Arg.

Xaa19 is selected from Ala and Val. Preferably, Xaa19 is Ala.

Xaa20 is selected from Arg, Gln and His. Preferably, Xaa20 is Gln or His. In one embodiment, Xaa20 is Arg; in another embodiment, Xaa20 is Gln; in a further embodiment Xaa20 is His.

Xaa21 is selected from Asp, Leu, His and Glu. Preferably, Xaa21 is Glu or Asp, for example Xaa21 is Glu.

Xaa23 is selected from Ile and Val. Preferably Xaa23 is Ile.

Xaa24 is selected from Gln and Glu. Preferably Xaa24 is Glu or Gln, in particular Glu.

Xaa27 is selected from Asn, Leu and Lys. Preferably Xaa27 is Leu.

Xaa28 is selected from Ala, Asn, Gln, Gly, His, Thr, Leu Ser, and Ile. Preferably Xaa28 is Ala, Asn, Gln, His or Thr. For example, Xaa28 is Ala, Asn, Gln or His, in particular Gln.

Xaa29 is selected from Gly, His, Ser and Thr. Preferably Xaa29 is Gly, Ser or Thr, in particular Ser.

In a preferred embodiment, X is an amino acid sequence:

[SEQ ID NO: 750]
His1-AIB2-His3-Gly4-Thr5-Phe6-Thr7-Ser8-Asp9-

Tyr10-Ser11-Xaa12-Tyr13-Leu14-Asp15-Xaa16-

Xaa17-Arg18-Ala19-Xaa20-Glu21-Phe22-Ile23-

Glu24-Trp25-Leu26-Leu27-Xaa28-Xaa29- wherein
Xaa12 is Arg or Lys;
Xaa16 is Ala, Gln or Glu;
Xaa17 is Arg or Lys;
Xaa20 is Arg, Gln or His; for example Gln or His;
Xaa28 is Ala, Asn, Gln or His; and
Xaa29 is Gly, Ser or Thr.

In a particularly preferred embodiment, X is an amino acid sequence:

[SEQ ID NO: 751]
His1-AIB2-His3-Gly4-Thr5-Phe6-Thr7-Ser8-Asp9-

Tyr10-Ser11-Lys12-Tyr13-Leu14-Asp15-Ala16-

Lys17-Arg18-Ala19-Xaa20-Glu21-Phe22-Ile23-

Glu24-Trp25-Leu26-Leu27-Gln28-Ser29- wherein
Xaa20 is Arg, Gln or His.

In such a compound, Xaa20 is preferably Gln.

In the W portion of the molecule, in an embodiment, W has an amino acid sequence selected from:

[SEQ ID NO: 752]
-Gly30-His31-His32-His33-His34-

[SEQ ID NO: 753]
-His30-His31-His32-His33-His34-

[SEQ ID NO: 754]
-His30-His31-Gln32-His33-His34-

[SEQ ID NO: 755]
-His30-Gln31-Gln32-Gln33-His34-

[SEQ ID NO: 756]
-His30-Gln31-His32-Pro33-Ser34-

[SEQ ID NO: 757]
-His30-Gln31-His32-Glu33-Ser34-

[SEQ ID NO: 758]
-His30-His31-Gln32-Glu33-Ser34-

[SEQ ID NO: 759]
-His30-His31-Gln32-Ser33-Pro34-

[SEQ ID NO: 760]
-His30-Glu31-Pro32-Ser33-Pro34-

[SEQ ID NO: 761]
-His30-Glu31-Glu32-Ser33-Pro34-

[SEQ ID NO: 762]
-His30-Gln31-Gln32-Glu33-Ser34-

[SEQ ID NO: 763]
-Gln30-His31-Gln32-His33-Gln34-

[SEQ ID NO: 764]
-His30-Gln31-Gln32-His33-His34-

[SEQ ID NO: 765]
-His30-His31-Gln32-His33-Gln34-

[SEQ ID NO: 766]
-His30-His31-Gln32-Gln33-His34-

[SEQ ID NO: 767]
-His30-Gln31-Glu32-Ser33-Pro34-

[SEQ ID NO: 768]
-His30-Gln31-Gln32-Pro33-Ser34-

[SEQ ID NO: 769]
-Gln30-Gln31-His32-Pro33-Ser34-

[SEQ ID NO: 770]
-Gln30-Gln31-His32-Glu33-Ser34-

[SEQ ID NO: 771]
-His30-Gln31-Gln32-Ser33-Pro34-

[SEQ ID NO: 772]
-His30-Gln31-Gln32-His33-Ser34-

[SEQ ID NO: 773]
-His30-Gln31-Gly32-Ala33-Pro34-

[SEQ ID NO: 774]
-Gly30-His31-Gly32-Ala33-Pro34-

[SEQ ID NO: 775]
-His30-Gly31-Gln32-Gly33-Ala34-

[SEQ ID NO: 776]
-His30-Gln31-Gln32-His33-Glu34-

[SEQ ID NO: 777]
-His30-Pro31-Ser32-Ser33-Gly34-

[SEQ ID NO: 778]
-Gln30-His31-Gln32-His33-Pro34-

[SEQ ID NO: 779]
-Gln30-His31-Gln32-His33-His34-

[SEQ ID NO: 780]
-His30-Gln31-His32-Gln33-His34-

[SEQ ID NO: 781]
-Gly30-Pro31-His32-Ser33-Gly34-

[SEQ ID NO: 782]
-His30-Pro31-His32-Ser33-Gly34-

[SEQ ID NO: 783]
-Gly30-Pro31-His32-His33-Gly34-

[SEQ ID NO: 784]
-His30-His31-Gln32-Gln33-Gln34-

[SEQ ID NO: 785]
-Gly30-Pro31-Ser32-His33-Gly34-

[SEQ ID NO: 786]
-Gly30-His31-Ser32-Ser33-Gly34-

[SEQ ID NO: 787]
-His30-Gln31-His32-Ser33-Gly34-

[SEQ ID NO: 788]
-His30-His31-Glu32-Ser33-Pro34-

[SEQ ID NO: 789]
-His30-His31-Ser32-Ser33-Gly34-

[SEQ ID NO: 790]
-His30-Gln31-Gln32-His33-Gly34-

[SEQ ID NO: 791]
-His30-His31-Gln32-His33-Glu34-

[SEQ ID NO: 792]
-His30-Gln31-Gln32-His33-Pro34-

[SEQ ID NO: 793]
-Gly30-Pro31-His32-Gln33-His34-
and

[SEQ ID NO: 794]
-Gly30-Pro31-Gln32-His33-Pro34-.

In particular, in a compound of the invention W has the amino acid sequence:

[SEQ ID NO: 795]
-Xaa30-Xaa31-Xaa32-Xaa33-Xaa34-;

wherein:

Xaa30 is His or Gln;

Xaa31 is His or Gln;

Xaa32 is His or Gln;

Xaa33 is His, Gln, Glu or Pro; or

Xaa34 is His, Glu, Pro or Ser.

In a preferred compound of the invention, W has the amino acid sequence:

[SEQ ID NO: 756]
-His30-Gln31-His32-Pro33-Ser34-

[SEQ ID NO: 776]
-His30-Gln31-Gln32-His33-Glu34-

[SEQ ID NO: 780]
-His30-Gln31-His32-Gln33-His34-

[SEQ ID NO: 766]
-His30-His31-Gln32-Gln33-His34-

[SEQ ID NO: 770]
-Gln30-Gln31-His32-Glu33-Ser34-

[SEQ ID NO: 792]
-His30-Gln31-Gln32-His33-Pro34-

In an embodiment, within the W portion of the molecule, it is preferred that W is an amino acid sequence:

-His30-His31-His32-His33-His34-; [SEQ ID NO: 796]

wherein optionally one of the five His residues may each independently be replaced by an amino acid selected from Gly, Ala, Glu, Gln and Ser, for example replaced by Gln. In a preferred embodiment, the residue that is replaced is the third of the five residues. For example, wherein W has the amino acid sequence:

-His30-His31-His32-His33-His34-; [SEQ ID NO: 753]
or

-His30-His31-Gln32-His33-His34-. [SEQ ID NO: 754]

Within the Y1 portion of the molecule, it is preferred that Y1 is an amino acid sequence in which:
Xaa35 is Pro, His, Glu, Ser or Ala;
Xaa36 is Ser, Gly, Pro or Thr;
Xaa37 is Pro, Ala, Ser, Glu, Gly or absent;
Xaa38 is Pro, Gly, Ala, Ser or absent;
Xaa39 is Pro, Gly, Ala, Ser or absent;
Xaa40 is Pro, Gly, Ser or absent;
Xaa41 is Gly, Ser or absent
Xaa43 is Ser or absent; and
Xaa44 is Trp or absent.

Within the Y1 portion of the molecule, in one embodiment it is preferred that Y1 is an amino acid sequence in which:
Xaa35 is Pro, Glu, Ser or Ala;
Xaa36 is Ser or Gly;
Xaa37 is Pro, Glu, Gly or absent;
Xaa38 is Pro, Gly or absent;
Xaa39 is Pro, Gly, Ser or absent;
Xaa40 is Gly, Ser or absent;
Xaa41 is Gly, Ser or absent
Xaa43 is Ser or absent; and
Xaa44 is Trp or absent.

For example, in a preferred embodiment, Y1 is an amino acid sequence in which:
Xaa35 is Pro, Glu or Ser;
Xaa36 is Ser, Gly or Pro;
Xaa37 is Pro, Ala or Ser;
Xaa38 is Pro, Ala, Ser or absent;
Xaa39 is Pro, Gly, Ala or absent;
Xaa40 is Gly or absent;
Xaa41 is absent
Xaa43 is absent; and
Xaa44 is absent.

In particular, it is preferred that:
Xaa35 is Pro or Glu;
Xaa36 is Ser;
Xaa37 is Pro or absent;
Xaa38 is Pro or absent;
Xaa39 is Pro, Gly, Ser or absent;
Xaa40 is Gly, Ser or absent;
Xaa41 is Gly, Ser or absent
Xaa43 is Ser or absent; and
Xaa44 is Trp or absent.

Considering the residues in turn, Xaa35 is selected from Pro, His, Glu, Ser and Ala. Preferably, Xaa35 is Pro, Glu, Ser or Ala, for example Xaa35 is Pro, Glu or Ser; for example Xaa35 is Pro or Glu.

Xaa36 is selected from Ser, Gly, Pro and Thr, for example Ser, Gly and Thr. Preferably, Xaa36 is Ser, Gly or Pro, for example Ser or Gly, example Xaa36 is Ser.

Xaa37 is selected from Pro, Ala, Ser, Glu, Gly or it is absent, for example Pro, Glu, Gly or absent. Preferably, Xaa37 is Pro, Ala, Ser or absent, for example Xaa37 is Pro, Ala or Ser, for example Xaa37 is Pro.

Xaa38 is selected from Pro, Gly, Ala, Ser or it is absent, for example Pro, Gly, Ser or absent. Preferably, Xaa38 is Pro, Ala, Ser or absent, for example Xaa38 is Pro.

Xaa39 is selected from Pro, Gly, Ala, Ser or it absent, for example Pro, Gly, Ser or it is absent. Preferably, Xaa39 is Pro, Gly, Ala or it is absent, for example Xaa39 is Pro.

Xaa40 is selected from Pro, Gly, Ser or it is absent. Preferably, Xaa40 is Gly or Ser; for example Xaa40 is Gly or absent, for example Gly.

Xaa41 is selected from Gly, Ser or it is absent. Preferably, Xaa41 is Gly or absent, for example it is absent.

Xaa43 is selected from Ser or it is absent. Preferably, Xaa43 is absent.

Xaa44 is selected from Trp or it is absent. Preferably, Xaa44 is absent.

In a preferred embodiment, Y1 is an amino acid sequence:

-Pro35-Pro36-Pro37-Lys42; [SEQ ID NO: 797]

-Ser35-Pro36-Pro37-Pro38-Lys42; [SEQ ID NO: 798]

-Glu35-Ser36-Pro37-Pro38-Pro39-Gly40-Lys42; [SEQ ID NO: 799]

-Glu35-Ser36-Pro37-Pro38-Pro39-Lys42; [SEQ ID NO: 800]

-Ser35-Gly36-Ala37-Lys42; [SEQ ID NO: 801]

-Ser35-Pro36-Pro37-Pro38-Gly39-Lys42; [SEQ ID NO: 802]

-Ser35-Ser36-Ser37-Ser38-Ala39-Lys42; [SEQ ID NO: 803]
or

-Ser35-Ser36-Ser37-Ala38-Lys42. [SEQ ID NO: 804]

In a preferred embodiment, Y1 is an amino acid sequence:

-Pro35-Ser36-Pro37-Pro38-Pro39-Gly40-Lys42; [SEQ ID NO: 805]

-Glu35-Ser36-Pro37-Pro38-Pro39-Gly40-Lys42; [SEQ ID NO: 799]
or

-Glu35-Ser36-Pro37-Pro38-Pro39-Ser40-Gly41-Lys42. [SEQ ID NO: 806]

For example, Y1 is an amino acid sequence:

-Glu35-Ser36-Pro37-Pro38-Pro39-Gly40-Lys42. [SEQ ID NO: 799]

In the compounds of the invention, the ε-amino group on Lys42 is attached to the acid group of the Xaa48 residue of the Y2 portion of the molecule, such that the bond is an amide bond. If Xaa48 or one or more other amino acids of the sequence Z-Xaa45-Xaa46-Xaa47-Xaa48 [SEQ ID NO: 745] is absent, then the ε-amino group on Lys42 is attached to the acid group of the next residue that is present which can be the acid group of the Z group (if all of Xaa45, Xaa46, Xaa47 and Xaa48 are absent).

In a lysine residue, the ε-amino group is the amino group that is attached to the 6-carbon. Following standard IUPAC nomenclature, the atoms in lysine are numbered as follows, indicating the carbon atom numbering and also the α to ε positions:

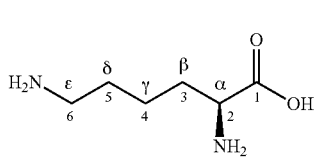

The ε-amino group on Lys42 that is referred to herein is the amino group on the C-6 carbon atom as indicated.

Within the Y2 portion of the molecule, it is preferred that Y2 is:

```
                                        [SEQ ID NO: 807]
    Z-Xaa45-Xaa46-Xaa47-Xaa48-
``` wherein:
Xaa45 is Gly, Thr or absent
Xaa46 is Ser, Gly, Thr or absent
Xaa47 is Gly, Asn, Ser, Gln, Thr, His, Tyr, Ala or absent; and
Xaa48 is Ser, Thr, His, Gln, Gly, Asn or absent.

Within the Y2 portion of the molecule, for example Y2 is:

```
                                        [SEQ ID NO: 808]
    Z-Xaa45-Xaa46-Xaa47-Xaa48-
``` wherein:
Xaa45 is Gly, Thr or absent
Xaa46 is Ser, Gly or absent
Xaa47 is Gly, Asn, Ser, Gln, Thr, His, Tyr or absent; and
Xaa48 is Ser, Thr, His, Gln, Gly, Asn or absent.

In particular, it is preferred that Xaa47 is Gly, Asn, Ser or absent.

In an alternative embodiment, Y2 is an amino acid sequence in which:
Xaa45 is absent
Xaa46 is absent
Xaa47 is Gly, Asn or absent;
Xaa48 is Ser, His, Asn or absent.

Considering the residues in turn, Xaa45 is selected from Gly, Thr or it is absent. Preferably, Xaa45 is absent.

Xaa46 is selected from Ser, Gly, Thr or it is absent. Preferably, Xaa46 is Ser, Gly or absent; for example Xaa46 is absent.

Xaa47 is selected from Gly, Asn, Ser, Gln, Thr, His Tyr, Ala or it is absent. Preferably, Xaa47 is Gly, Asn, Ser, Gln, Thr, His, Tyr or it is absent. For example Xaa47 is Gly, Asn, Ser or absent, for example Gly, Asn or absent; for example it is Asn.

Xaa48 is selected from Ser, Thr, His, Gln, Gly, Asn or it is absent; For example Xaa48 is Ser, Thr, His, Gln, Gly, Asn or absent, for example, it is Ser, His or absent. Preferably, Xaa48 is present and selected from Ser, Thr, His, Gln, Gly and Asn, for example selected from Ser or His, for example His.

In a preferred embodiment, Y2 is:

```
    Z-Gly47-Ser48-;

Z-Ser46-Gly47-Thr48-;

Z-Asn47-His48-;

Z-Gln48-;

Z-;

[SEQ ID NO: 809]
    Z-Gly45-Ser46-Gly47-Ser48-;

Z-Asn48-;
    or
                                        [SEQ ID NO: 810]
    Z-Thr45-Gly46-Ser47-Gly48-.
```

For example, Y2 is:

```
    Z-Gly47-Ser48-;

Z-Ser46-Gly47-Thr48-;

Z-Asn47-His48-;

Z-Gln48-;

[SEQ ID NO: 809]
    Z-Gly45-Ser46-Gly47-Ser48-;

Z-Asn48-;
    or
                                        [SEQ ID NO: 810]
    Z-Thr45-Gly46-Ser47-Gly48-.
```

In a preferred embodiment, Y2 is:

```
    Z-Gly47-Ser48-;

Z-Asn47-His48-;

Z-;
    or

Z-Asn48-.
```

For example, Y2 is Z-Asn47-His48-.

Within the Z portion of the molecule, Z is a group selected from:

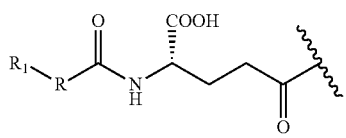

(i)

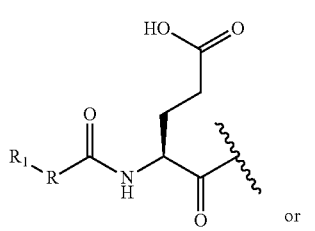

(ii)

or

-continued

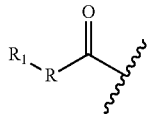
(iii)

wherein R is a $C_8$-$C_{28}$ alkylene or alkenylene group and $R^1$ is $CO_2H$.

It is preferred that Z is a group (i).

Group R is an alkylene or alkenylene chain which is linked at one end to residue Xaa48 (or, if Xaa48 and one or more further residues of Xaa45 to Xaa47 are absent, the next residue that is present) by an amide bond. At its other end, the R alkylene or alkenylene chain is bonded to the $R^1$ acid group ($C_{02}H$).

Generally, R has an even number of carbon atoms. For example, R can be an alkylene or alkenylene chain that is found in naturally-occurring fatty acids. The root fatty acid has a chain length two higher than the number of carbon atoms in the R an alkylene or alkenylene chain.

Preferably, R is a $C_{14}$, $C_{16}$, $C_{18}$, $C_{20}$ or $C_{22}$ group. For example, R is straight chain alkylene or alkenylene group. For example, R is a $C_{16}$ or $C_{18}$ straight chain alkylene group. For example, when R is a $C_{14}$, group, it can be provided by a hexadecanedioic acid moiety. For example, when R is a $C_{16}$, group, it can be provided by a octadecanedioic acid moiety. For example, when R is a $C_{18}$, group, it can be provided by an eicosanedioic acid moiety. For example, when R is a $C_{20}$, group, it can be provided by a docosanedioic acid moiety. For example, when R is a $C_{22}$, group, it can be provided by a tetracosanedioic acid moiety.

In a preferred embodiment, the compound of the invention is a compound of Formula (I):

X-W-Y1-Y2          Formula (I)

Wherein X is an amino acid sequence:

[SEQ ID NO: 811]
His1-Xaa2-Xaa3-Gly4-Thr5-Phe6-Thr7-Ser8-Asp9-
Xaa10-Ser11-Xaa12-Xaa13-Leu14-Xaa15-Xaa16-
Xaa17-Xaa18-Xaa19-Xaa20-Xaa21-Phe22-Xaa23-Xaa24-
Trp25-Leu26-Xaa27-Xaa28-Xaa29- wherein
  Xaa2 is AIB;
  Xaa3 is His, Gln or Glu;
  Xaa10 is Leu or Tyr;
  Xaa12 is Arg or Lys;
  Xaa13 is Tyr or Gln;
  Xaa15 is Asp or Glu;
  Xaa16 is Ala, Gln, Glu or Ser;
  Xaa17 is Arg, Glu or Lys;
  Xaa18 is Ala, Arg or Lys;
  Xaa19 is Ala or Val;
  Xaa20 is Arg, Gln or His;
  Xaa21 is Asp, Glu or Leu;
  Xaa23 is Ile or Val;
  Xaa24 is Gln or Glu;
  Xaa27 is Leu or Lys;
  Xaa28 is Ala, Asn, Gln or His; and
  Xaa29 is Gly, Ser or Thr;

W is an amino acid sequence selected from:

[SEQ ID NO: 752]
-Gly30-His31-His32-His33-His34-

[SEQ ID NO: 753]
-His30-His31-His32-His33-His34-

[SEQ ID NO: 754]
-His30-His31-Gln32-His33-His34-

[SEQ ID NO: 755]
-His30-Gln31-Gln32-Gln33-His34-

[SEQ ID NO: 756]
-His30-Gln31-His32-Pro33-Ser34-

[SEQ ID NO: 757]
-His30-Gln31-His32-Glu33-Ser34-

[SEQ ID NO: 758]
-His30-His31-Gln32-Glu33-Ser34-

[SEQ ID NO: 759]
-His30-His31-Gln32-Ser33-Pro34-

[SEQ ID NO: 760]
-His30-Glu31-Pro32-Ser33-Pro34-

[SEQ ID NO: 761]
-His30-Glu31-Glu32-Ser33-Pro34-

[SEQ ID NO: 762]
-His30-Gln31-Gln32-Glu33-Ser34-

[SEQ ID NO: 763]
-Gln30-His31-Gln32-His33-Gln34-

[SEQ ID NO: 764]
-His30-Gln31-Gln32-His33-His34-

[SEQ ID NO: 765]
-His30-His31-Gln32-His33-Gln34-

[SEQ ID NO: 766]
-His30-His31-Gln32-Gln33-His34-

[SEQ ID NO: 767]
-His30-Gln31-Glu32-Ser33-Pro34-

[SEQ ID NO: 768]
-His30-Gln31-Gln32-Pro33-Ser34-

[SEQ ID NO: 769]
-Gln30-Gln31-His32-Pro33-Ser34-

[SEQ ID NO: 770]
-Gln30-Gln31-His32-Glu33-Ser34-

[SEQ ID NO: 771]
-His30-Gln31-Gln32-Ser33-Pro34-

[SEQ ID NO: 772]
-His30-Gln31-Gln32-His33-Ser34-

[SEQ ID NO: 773]
-His30-Gln31-Gly32-Ala33-Pro34-

[SEQ ID NO: 774]
-Gly30-His31-Gly32-Ala33-Pro34-

[SEQ ID NO: 775]
-His30-Gly31-Gln32-Gly33-Ala34-

[SEQ ID NO: 776]
-His30-Gln31-Gln32-His33-Glu34-

[SEQ ID NO: 777]
-His30-Pro31-Ser32-Ser33-Gly34-

-continued

[SEQ ID NO: 778]
-Gln30-His31-Gln32-His33-Pro34-

[SEQ ID NO: 779]
-Gln30-His31-Gln32-His33-His34-

[SEQ ID NO: 780]
-His30-Gln31-His32-Gln33-His34-

[SEQ ID NO: 781]
-Gly30-Pro31-His32-Ser33-Gly34-

[SEQ ID NO: 782]
-His30-Pro31-His32-Ser33-Gly34-

[SEQ ID NO: 783]
-Gly30-Pro31-His32-His33-Gly34-

[SEQ ID NO: 784]
-His30-His31-Gln32-Gln33-Gln34-

[SEQ ID NO: 785]
-Gly30-Pro31-Ser32-His33-Gly34-

[SEQ ID NO: 786]
-Gly30-His31-Ser32-Ser33-Gly34-

[SEQ ID NO: 787]
-His30-Gln31-His32-Ser33-Gly34-

[SEQ ID NO: 788]
-His30-His31-Glu32-Ser33-Pro34-

[SEQ ID NO: 789]
-His30-His31-Ser32-Ser33-Gly34-

[SEQ ID NO: 790]
-His30-Gln31-Gln32-His33-Gly34-

[SEQ ID NO: 791]
-His30-His31-Gln32-His33-Glu34-

[SEQ ID NO: 792]
-His30-Gln31-Gln32-His33-Pro34-

[SEQ ID NO: 793]
-Gly30-Pro31-His32-Gln33-His34-
and

[SEQ ID NO: 794]
-Gly30-Pro31-Gln32-His33-Pro34-;

Y1 is an amino acid sequence in which:
Xaa35 is Pro, His, Glu, Ser or Ala;
Xaa36 is Ser, Gly, Pro or Thr;
Xaa37 is Pro, Ala, Ser, Glu, Gly or absent;
Xaa38 is Pro, Gly, Ala, Ser or absent;
Xaa39 is Pro, Gly, Ala, Ser or absent;
Xaa40 is Pro, Gly, Ser or absent;
Xaa41 is Gly, Ser or absent
Xaa43 is Ser or absent;
Xaa44 is Trp or absent;
Y2 is selected from:

Z-Gly47-Ser48-;

Z-Ser46-Gly47-Thr48-;

Z-Asn47-His48-;

Z-Gln48-;

Z-;

[SEQ ID NO: 809]
Z-Gly45-Ser46-Gly47-Ser48-;

Z-Asn48-;
and

[SEQ ID NO: 810]
Z-Thr45-Gly46-Ser47-Gly48-;

and Z is a group of formula:

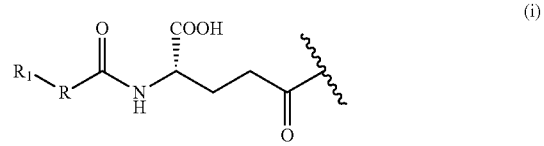

wherein R is a $C_{14}$, $C_{16}$, $C_{18}$, $C_{20}$ or $C_{22}$ straight chain alkylene group and
$R^1$ is $CO_2H$.
For example, the compound of the invention is a compound of Formula (I):

X-W-Y1-Y2        Formula (I)

wherein:
X is an amino acid sequence:

[SEQ ID NO: 742]
His1-Xaa2-Xaa3-Gly4-Thr5-Phe6-Thr7-Ser8-Asp9-

Xaa10-Ser11-Xaa12-Xaa13-Leu14-Xaa15-Xaa16-Xaa17-

Xaa18-Xaa19-Xaa20-Xaa21-Phe22-Xaa23-Xaa24-

Trp25-Leu26-Xaa27-Xaa28-Xaa29- wherein
Xaa2 is AIB or Ser;
Xaa3 is His, Glu, Gln, Asp or Phe;
Xaa10 is Leu, Tyr or Val;
Xaa12 is Arg, Lys or His;
Xaa13 is Tyr, Gln or His
Xaa15 is Asp or Glu;
Xaa16 is Ala, Gln, Glu, Ser, His or Thr;
Xaa17 is Arg, Glu, His or Lys;
Xaa18 is Ala, Arg or Lys;
Xaa19 is Ala or Val;
Xaa20 is Arg, Gln or His;
Xaa21 is Asp, Leu, His or Glu;
Xaa23 is Ile or Val;
Xaa24 is Gln or Glu;
Xaa27 is Asn, Leu or Lys;
Xaa28 is Ala, Asn, Gln, Gly, His, Thr, Leu, Ser, or Ile; and
Xaa29 is Gly, His, Ser or Thr;
W is an amino acid sequence:

[SEQ ID NO: 797]
-His30-His31-His32-His33-His34-;

wherein optionally up to two of the five His residues may each independently be replaced by an amino acid selected from Gly, Ala, Glu, Gln and Ser;
Y1 is an amino acid sequence:

[SEQ ID NO: 812]
-Xaa35-Xaa36-Xaa37-Xaa38-Xaa39-Xaa40-Xaa41-Lys42-
Xaa43-Xaa44 wherein
Xaa35 is Pro, His, Glu, Ser or Ala;
Xaa36 is Ser, Gly or Thr;
Xaa37 is Pro, Glu, Gly or absent;
Xaa38 is Pro, Gly, Ser or absent;
Xaa39 is Pro, Gly, Ser or absent;
Xaa40 is Pro, Gly, Ser or absent;
Xaa41 is Gly, Ser or absent
Xaa43 is Ser or absent;
Xaa44 is Trp or absent;
and the lysine residue at position 42 is substituted at its ε-amino group with the group Y2
and Y2 is:

[SEQ ID NO: 745]
Z-Xaa45-Xaa46-Xaa47-Xaa48- wherein:
Xaa45 is Ser, Gly, Thr or absent
Xaa46 is Ser, Gly, Thr or absent
Xaa47 is Gly, Asn, Ser, Gln, Thr, His, Tyr, Ala or absent; and
Xaa48 is Ser, Thr, His, Gln, Gly, Asn or absent;
and Z is a group of formula:

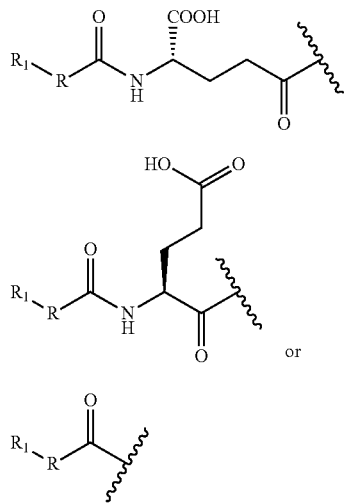

wherein R is a $C_8$-$C_{28}$ alkylene or alkenylene group and $R^1$ is $CO_2H$.

Such a compound may have the preferred features described hereinabove.

For example, the compound of the invention is a compound of Formula (I):

X-W-Y1-Y2    Formula (I)

Wherein X is an amino acid sequence:

[SEQ ID NO: 813]
His1-AIB2-His3-Gly4-Thr5-Phe6-Thr7-Ser8-Asp9-
Tyr10-Ser11-Xaa12-Tyr13-Leu14-Asp15-Xaa16-Xaa17-
Arg18-Ala19-Xaa20-Glu21-Phe22-Ile23-Glu24-Trp25-
Leu26-Leu27-Xaa28-Xaa29- wherein
Xaa12 is Arg or Lys;
Xaa16 is Ala, Gln or Glu;
Xaa17 is Arg or Lys;
Xaa20 is Gln or His;
Xaa28 is Ala, Asn, Gln or His; and
Xaa29 is Gly, Ser or Thr.
W is an amino acid sequence:

[SEQ ID NO: 753]
-His30-His31-His32-His33-His34-;
or

[SEQ ID NO: 754]
-His30-His31-Gln32-His33-His34-.

Y1 is an amino acid sequence:

[SEQ ID NO: 805]
-Pro35-Ser36-Pro37-Pro38-Pro39-Gly40-Lys42;

[SEQ ID NO: 799]
-Glu35-Ser36-Pro37-Pro38-Pro39-Gly40-Lys42;
or

[SEQ ID NO: 806]
-Glu35-Ser36-Pro37-Pro38-Pro39-Ser40-Gly41-Lys42.

Y2 is selected from:

Z-Gly47-Ser48-;

Z-Ser46-Gly47-Thr48-;

Z-Asn47-His48-;

Z-Gln48-;

Z-;

[SEQ ID NO: 809]
Z-Gly45-Ser46-Gly47-Ser48-;

Z-Asn48-;
and

[SEQ ID NO: 810]
Z-Thr45-Gly46-Ser47-Gly48-;

and Z is a group of formula:

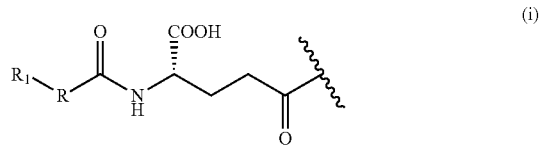

wherein R is a $C_{16}$ or $C_{18}$ straight chain alkylene group and
$R^1$ is $CO_2H$.

For example, the compound of the invention is a compound of Formula (I):

X-W-Y1-Y2    Formula (I)

Wherein X is an amino acid sequence:

[SEQ ID NO: 751]
His1-AIB2-His3-Gly4-Thr5-Phe6-Thr7-Ser8-Asp9-
Tyr10-Ser11-Lys12-Tyr13-Leu14-Asp15-Ala16-Lys17-

-continued

```
Arg18-Ala19-Xaa20-Glu21-Phe22-Ile23-Glu24-Trp25-

Leu26-Leu27-Gln28-Ser29-
```

Wherein Xaa20 is Arg, Gln or His;

```
                                        [SEQ ID NO: 756]
-His30-Gln31-His32-Pro33-Ser34-

[SEQ ID NO: 776]
-His30-Gln31-Gln32-His33-Glu34-

[SEQ ID NO: 780]
-His30-Gln31-His32-Gln33-His34-

[SEQ ID NO: 766]
-His30-His31-Gln32-Gln33-His34-

[SEQ ID NO: 770]
-Gln30-Gln31-His32-Glu33-Ser34-

[SEQ ID NO: 792]
-His30-Gln31-Gln32-His33-Pro34-
```

Y1 is an amino acid sequence:

```
                                        [SEQ ID NO: 797]
-Pro35-Pro36-Pro37-Lys42;

[SEQ ID NO: 798]
-Ser35-Pro36-Pro37-Pro38-Lys42;

[SEQ ID NO: 799]
-Glu35-Ser36-Pro37-Pro38-Pro39-Gly40-Lys42;

[SEQ ID NO: 800]
-Glu35-Ser36-Pro37-Pro38-Pro39-Lys42;

[SEQ ID NO: 801]
-Ser35-Gly36-Ala37-Lys42;

[SEQ ID NO: 802]
-Ser35-Pro36-Pro37-Pro38-Gly39-Lys42;

[SEQ ID NO: 803]
-Ser35-Ser36-Ser37-Ser38-Ala39-Lys42;
or
                                        [SEQ ID NO: 804]
-Ser35-Ser36-Ser37-Ala38-Lys42;
```

Y2 is selected from:

```
Z-Gly47-Ser48-;

Z-Asn47-His48-;

Z-;
or

Z-Asn48-;
```

Z is a group of formula:

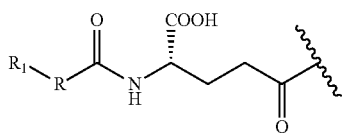

(i)

wherein R is a $C_{16}$ or $C_{18}$ straight chain alkylene group and $R^1$ is $C_{O2}H$.

This group of compounds is referred to below as group I.

In especially preferred embodiments, the compound is one of the compounds of the invention set out in the Table of FIG. 1 or the Table of FIG. 2.

Derivatives and Salts

The present invention provides compounds of formula (I), derivatives of such compounds, and salts or solvates of such compounds and derivatives.

The compounds, derivatives and salts may be produced by recombinant methods which are well-known in the art or alternatively they may be produced by synthetic methods, again which are well-known in the art.

Derivatives

Whilst in some embodiments, the invention relates to a compound of formula (I) and is not a derivative, in other embodiments the invention relates to a derivative of a compound of formula (I). The derivative may for example comprise one or more derivatisations selected from amidation, glycosylation, carbamylation, acylation, sulfation, phosphorylation, cyclization, lipidization, pegylation and fusion to another peptide or protein to form a fusion protein. The structure may be modified at random positions within the molecule, or at predetermined positions within the molecule and may include one, two, three or more attached chemical moieties.

In certain embodiments it is preferred that the primary peptide chain of compounds of the invention may be amidated at their C-terminal. Such a modification is very common in nature with approximately half of naturally occurring peptides, including certain gastrointestinal peptide hormones, being susceptible to amidation at their C-terminal. The present invention encompasses all of the generic and specific sequences disclosed herein, including in the sequence listing and drawings, in both amidated and non-amidated forms, the amidation, where present being especially preferred on the C-terminal of the primary peptide sequence.

The derivative may for example be a fusion protein, whereby the structure of formula (I) is fused to another protein or polypeptide (the fusion partner) using recombinant methods known in the art. Alternatively, such a fusion protein may be synthetically synthesized by any known method. Such a fusion protein comprises the structure of formula (I). Any suitable peptide or protein can be used as the fusion partner (e.g., serum albumin, carbonic anhydrase, glutathione-S-transferase or thioredoxin, etc.).

Such fusion proteins may be made by linking the carboxy-terminus of the fusion partner to the amino-terminus of the structure of formula (I) or vice versa. Optionally, a cleavable linker may be used to link the structure of formula (I) to the fusion partner. A resulting cleavable fusion protein may be cleaved in vivo such that an active form of a compound of the invention is released. Examples of such cleavable linkers include, but are not limited to, the linkers Asp-Asp-Asp-Asp-Tyr [SEQ ID NO: 814], Gly-Pro-Arg, Ala-Gly-Gly and His-Pro-Phe-His-Leu [SEQ ID NO: 815], which can be cleaved by enterokinase, thrombin, ubiquitin cleaving enzyme and renin, respectively. For details, see for example U.S. Pat. No. 6,410,707, the contents of which are incorporated herein by reference.

A derivative of the invention may for example be a physiologically functional derivative of the structure of formula (I). The term "physiologically functional derivative" is used herein to denote a chemical derivative of a compound of formula (I) having the same physiological function as the corresponding unmodified compound. For example, a physiologically functionally derivative may be convertible in the body to a compound of formula (I). According to the present invention, examples of physiologically functional derivatives include esters, amides, and carbamates; preferably esters and amides.

In addition to the derivatisation at Lys42, compounds of the invention can be further derivatised at additional positions. For example, pharmaceutically acceptable esters and amides of the compounds of the invention may comprise a $C_{1-20}$ alkyl-, $C_{2-20}$ alkenyl-, $C_{5-10}$ aryl-, $C_{5-10}$ ar-$C_{1-20}$ alkyl-, or amino acid-ester group or amide group attached at an appropriate site, for example formed by reaction of an alkyl, alkenyl aryl, aralkyl or amino alkyl group containing an alcohol or amino moiety with an acid moiety present in the compound of formula (I), or formed by reaction of an alkyl, alkenyl aryl, aralkyl or amino alkyl group containing an activated acyl group with an alcohol or amine group present in the compound of formula (I). Examples of suitable moieties are hydrophobic substituents with 4 to 26 carbon atoms, preferably 5 to 19 carbon atoms. Suitable lipid groups include fatty acids (e.g. lauroyl ($C_{12}H_{23}$), palmityl ($C_{15}H_{31}$), oleyl ($C_{15}H_{29}$) or stearyl ($C_{17}H_{35}$)) and bile acids (e.g. cholate or deoxycholate).

Methods for lipidization of sulfhydryl-containing compounds with fatty acid derivatives are disclosed in U.S. Pat. Nos. 5,936,092; 6,093,692; and 6,225,445, the contents of which are incorporated herein by reference. Fatty acid derivatives of a compound of the invention comprising a compound of the invention linked to fatty acid via a disulfide linkage may be used for delivery of a compound of the invention to neuronal cells and tissues. Lipidisation markedly increases the absorption of the compounds relative to the rate of absorption of the corresponding unlipidised compounds, as well as prolonging blood and tissue retention of the compounds. Moreover, the disulfide linkage in a lipidised derivative is relatively labile in the cells and thus facilitates intracellular release of the molecule from the fatty acid moieties. Suitable lipid-containing moieties are hydrophobic substituents with 4 to 26 carbon atoms, preferably 5 to 17 carbon atoms. Suitable lipid groups include fatty acids (e.g. lauroyl ($C_{12}H_{23}$), palmityl ($C_{15}H_{31}$), oleyl ($C_{15}H_{29}$) or stearyl ($C_{17}H_{35}$)) and bile acids (e.g. cholate or deoxycholate). Whilst lipid functionalised compounds of the invention may have benefits in certain situations, it is expected that in most cases, it will be simplest and preferred if a compound of the invention is not further derivatised, such that there are not additional lipid groups present.

Cyclization methods include cyclization through the formation of a disulfide bridge, and head-to-tail cyclization using a cyclization resin. Cyclized peptides may have enhanced stability, including increased resistance to enzymatic degradation, as a result of their conformational constraints. Cyclization may in particular be expedient where the uncyclized peptide includes an N-terminal cysteine group. Suitable cyclized peptides include monomeric and dimeric head-to-tail cyclized structures. Cyclized peptides may include one or more additional residues, especially an additional cysteine incorporated for the purpose of formation of a disulfide bond or a side chain incorporated for the purpose of resin-based cyclization.

The derivative may for example be a PEGylated structure of formula (I). Derivatives which are PEGylated compounds of the invention may provide additional advantages such as increased solubility, stability and circulating time of the polypeptide, or decreased immunogenicity (see U.S. Pat. No. 4,179,337, the contents of which are incorporated herein by reference).

Chemical moieties for derivatisation of a compound of the invention may also be selected from water soluble polymers such as polyethylene glycol, ethylene glycol/propylene glycol copolymers, carboxymethylcellulose, dextran, polyvinyl alcohol and the like. A polymer moiety for derivatisation of a compound of the invention may be of any molecular weight and may be branched or unbranched. For ease in handling and manufacturing, the preferred molecular weight of a polyethylene glycol for derivatisation of a compound of the invention is from about 1 kDa to about 100 kDa, the term "about" indicating that in preparations of polyethylene glycol, some molecules will weigh more, some less, than the stated molecular weight. Polymers of other molecular weights may be used, depending on the desired therapeutic profile, for example the duration of sustained release desired, the effects, if any, on biological activity, the ease in handling, the degree or lack of antigenicity and other known effects of the polyethylene glycol to a therapeutic protein or analog. For example, the polyethylene glycol may have an average molecular weight of about 200, 500, 1000, 1500, 2000, 2500, 3000, 3500, 4000, 4500, 5000, 5500, 6000, 6500, 7000, 7500, 8000, 8500, 9000, 9500, 10,000, 10,500, 11,000, 11,500, 12,000, 12,500, 13,000, 13,500, 14,000, 14,500, 15,000, 15,500, 16,000, 16,500, 17,000, 17,500, 18,000, 18,500, 19,000, 19,500, 20,000, 25,000, 30,000, 35,000, 40,000, 45,000, 50,000, 55,000, 60,000, 65,000, 70,000, 75,000, 80,000, 85,000, 90,000, 95,000, or 100,000 kDa.

Salts

Salt forms of compounds of formula (I) and of derivatives of such compounds also form part of the invention. In some embodiments the salt is a salt of a compound of formula (I). In other embodiments the salt is a salt of a derivative of a compound of formula (I).

Salts of compounds of the invention include those which are pharmaceutically acceptable, i.e. which are suitable for use in medicine. However, salts having non-pharmaceutically acceptable counterions are also within the scope of the present invention, for example, for use as intermediates in the preparation of the compounds.

Suitable salts according to the invention include those formed with organic or inorganic acids or bases. Pharmaceutically acceptable acid addition salts include those formed with hydrochloric, hydrobromic, sulphuric, nitric, citric, tartaric, acetic, phosphoric, lactic, pyruvic, acetic, trifluoroacetic, succinic, perchloric, fumaric, maleic, glycolic, salicylic, oxaloacetic, methanesulfonic, ethanesulfonic, p-toluenesulfonic, formic, benzoic, malonic, naphthalene-2-sulfonic, benzenesulfonic, and isethionic acids. Other acids such as oxalic acid may be useful as intermediates in obtaining the compounds of the invention in final form.

Pharmaceutically acceptable salts with bases include ammonium salts, alkali metal salts, for example potassium and sodium salts, alkaline earth metal salts, for example calcium and magnesium salts, and salts with organic bases, for example dicyclohexylamine and N-methyl-D-glucomine.

Solvates

Those skilled in the art of organic and/or medicinal chemistry will appreciate that many organic compounds can form complexes with solvents in which they are reacted or from which they are precipitated or crystallized. Such complexes are known as "solvates". For example, a complex with water is known as a "hydrate". The invention also encompasses solvates of the compounds of formula (I), solvates of derivatives of the compounds, and solvates of salts of the derivatives.

Those skilled in the art of organic and/or medicinal chemistry will also appreciate than many organic compounds can exist in different forms, including as amorphous material and/or in one or more crystalline forms. Different physical forms of organic compounds are known as polymorphs. The invention also encompasses all such different physical forms of the compounds of formula (I), as well as different physical forms of their derivatives and salts.

Biological Activity

Compounds of the invention have agonistic activity at the human glucagon receptor and thus can be considered to be glucagon receptor agonists. This may be assessed by, for example, an in vitro or cellular binding assay or by a reporter assay. Preferred compounds of the invention exhibit an activity at the human glucagon receptor which is at least $1/10^{th}$ that of human glucagon, preferably an activity which is at least $1/5^{th}$, $1/3^{rd}$ or ½ that of human glucagon, for example when tested in accordance with the assay described in the examples section below. Certain preferred compounds of the invention exhibit an activity at the human glucagon receptor which is at least equivalent to that of human glucagon.

Methods of assessing activity at the glucagon receptor are well known. For example, Thermo Scientific (Lafayette, CO, USA) market an in vitro glucagon receptor assay.

Compounds of the invention also have activity at the human GLP-1 receptor and can be considered GLP-1 receptor agonists. This may be assessed by, for example, an in vitro or cellular binding assay or by a reporter assay. Preferred compounds of the invention exhibit an activity at the human GLP-1 receptor that is at least $1/50^{th}$ that of human GLP-1, preferably an activity which is at least $1/30^{th}$, $1/20^{th}$, $1/10^{th}$, $1/5^{th}$, $1/3^{rd}$ or ½ that of human GLP-1, for example when tested in accordance with the assay described in the examples section below. Certain preferred compounds of the invention exhibit an activity at the human GLP-1 receptor that is at least equivalent to that of human GLP-1.

Methods of assessing activity at the GLP-1 receptor are well known. For example, Mukai et al (2009) Biochem. Biophys. Re. Comm. 28993:523-6 discloses a method of assaying for GLP-1 receptor binding. A specific method is described herein below.

Preferred compounds of the invention are effective in promoting insulin release/secretion. This may be assessed by, for example, an in vitro assay. Methods of assessing release of insulin from beta-cells are well known.

Compounds of the invention fulfil some, or more preferably all, of the following criteria:

1) Sustained bioactivity at the human glucagon receptor resulting in enhancement of energy expenditure;
2) Sustained bioactivity at the human GLP-1 receptor resulting in inhibition of appetite;
3) Activity in promoting insulin release from beta-cells;
4) Low incidence of side effects such as nausea and vomiting, particularly at therapeutically effective dosage levels;
5) High solubility in aqueous solution at pH 5 to allow an effective dose to be administered in a low volume injection (thereby resulting in lower pain of injection). Solubility may be easily assessed by simple in vitro tests;
6) Long period of activity in vivo (as assessed in humans or an animal model) so as to permit injections no more frequently than daily and preferably no more than twice, or more preferably no more than once a week, whilst still producing acceptable therapeutic or cosmetic benefits;
7) Good weight loss (as assessed in human subjects or an animal model), with food intake either not reduced, or reduced by less that the level of the weight loss;
8) Low antigenicity in humans. This may be assessed in humans or animal models (in particular mice which have been experimentally reconstituted with a human immune system so as to mimic human antibody repertoire) or predicted using predictive software such as that incorporating the "antigenic index" algorithm ((Jameson & Wolf (1988) Comput. Appl. Biosci. 4(1): 181-6), or the PREDITOP algorithm (Pellequer & Westhof, (1993) J. Mol. Graph. 11(3):204-10), or using the methods of Kolaskar & Tongankar (1990) FEBS Leu. 10:276(1-2):172-4, the contents of which are incorporated herein by reference);

According to certain embodiments of the invention, especially embodiments relating to weight loss, obesity, carbohydrate metabolism and diabetes, the compounds, derivatives and salts of the invention have one, several or all of the following features:

A) Sufficient solubility between pH 4 and pH 5 to permit an effective dose to be administered in a volume of less than 1 ml, less than 0.5 ml or less than 0.3 ml;
B) Activation of cAMP signalling in human embryonic kidney cells over-expressing the human GLP-1 Receptor;
C) Activation of cAMP signalling in cells over-expressing the human glucagon receptor;
D) One, several or all of the further 1 to 8 features listed above.

Pharmacokinetics, Duration of Action and Solubility

Compounds of the present invention exhibit potent and prolonged duration of action in vivo following subcutaneous administration. In order to achieve this, the compounds are required to have both good activity at the biological target, and excellent pharmacokinetic properties.

Compounds of the present invention have a therapeutically useful duration of action and that manifests itself in the beneficial effects being observed in the experiments described herein below over several days. The half-life of compounds of the invention was assessed in a pig PK model. Preferred compounds of the invention were found to have a half life significantly longer than Semaglutide. As well as exhibiting a long in vivo half life, the compounds of the invention have good storage stability, with no significant degradation seen on storage in solution for 4 weeks at 25° C.

Poor water solubility is a known problem for lipid containing molecules. In contrast, the compounds of the invention have very good solubility.

Incorporation of His residue(s) into peptides having poor aqueous solubility typically leads to peptides having enhanced solubility at acidic pH (e.g. pH 5) due to the presence of charged His side-chain groups, but which are less soluble at physiological pH (pH 7.4). The pI of the side-chain group of histidine is about 6.0. Such properties enable formulation of His-containing peptides in weakly acidic media. Upon subcutaneous injection of such formulations, the solubility falls leading to subcutaneous precipitation of peptide which resolubilises over time. Zinc-containing formulations of His-containing peptides enhance this effect, because at pH 7.4 but not at pH 5 zinc ions co-ordinate with histidine residues and result in a further reduction in solubility which can contribute to increased precipitation at a subcutaneous injection site, or which can contribute to increased stability of the precipitate. However, where precipitation of peptide is not sufficiently rapid following subcutaneous administration, there may still be an initial "spike" or "burst" in blood concentration levels of the peptide. Such properties are undesirable since they increase the possibility of subjects experiencing side effects associated with high concentration levels of the peptides, such as nausea, even if only temporary. In contrast to peptides not having the multi-His containing C-terminal sequence of the invention, the present compounds either do not display initial "spikes" or "bursts" in plasma concentration levels following subcutaneous administration or any such "burst" is significantly reduced. This reduces the likelihood and/or severity of possible side effects associated with high circulating levels of the compounds.

Conditions

The invention also provides a compound, derivative or salt of the invention, or a composition comprising the compound, derivative or salt together with a pharmaceutically acceptable carrier and optionally a further therapeutic agent, for use as a medicament.

The invention also provides a method of treating or preventing a disease or disorder or other non-desired physiological state in a subject comprising administration of a therapeutically effective amount of a compound, derivative or salt of the invention, or of a composition comprising the compound, derivative or salt together with a pharmaceutically acceptable carrier and optionally a further therapeutic agent. Preferably the compound, derivative, salt or composition is administered subcutaneously.

According to certain embodiments, the disease or disorder or other non-desired physiological state is diabetes or obesity, and particularly diabetes (e.g. type II diabetes).

According to certain embodiments, the disease or disorder or other non-desired physiological state may be the physiological state of being overweight.

The subject to whom the compound is administered may be overweight, for example, obese. Alternatively, or in addition, the subject may be diabetic, for example having insulin resistance or glucose intolerance, or both. The subject may have diabetes mellitus, for example, the subject may have Type II diabetes. The subject may be overweight, for example, obese and have diabetes mellitus, for example, Type II diabetes.

In addition, or alternatively, the subject may have, or may be at risk of having, a disorder in which obesity or being overweight is a risk factor. Such disorders include, but are not limited to, heart disease, cardiovascular disease, for example hypertension, atherosclerosis, congestive heart failure, and dyslipidemia; stroke; gallbladder disease; osteoarthritis; sleep apnea; reproductive disorders for example, polycystic ovarian syndrome; cancers, for example breast, prostate, colon, endometrial, kidney, and esophagus cancer; varicose veins; acanthosis nigricans; eczema; exercise intolerance; insulin resistance; hypertension hypercholesterolemia; cholithiasis; osteoarthritis; orthopedic injury; insulin resistance, for example, type 2 diabetes and syndrome X; and thromboembolic disease (see Kopelman, Nature 404: 635-43; Rissanen et al., *British Med. J.* 301, 835, 1990).

Other disorders associated with obesity include depression, anxiety, panic attacks, migraine headaches, PMS, chronic pain states, fibromyalgia, insomnia, impulsivity, obsessive compulsive disorder, and myoclonus. Furthermore, obesity is a recognized risk factor for increased incidence of complications of general anesthesia (see e. g., Kopelman, Nature 404:635-43, 2000). In general, obesity reduces life span and carries a serious risk of co-morbidities such as those listed above.

Other diseases or disorders associated with obesity are birth defects, maternal obesity being associated with increased incidence of neural tube defects, carpal tunnel syndrome (CTS); chronic venous insufficiency (CVI); daytime sleepiness; deep vein thrombosis (DVT); end stage renal disease (ESRD); gout; heat disorders; impaired immune response; impaired respiratory function; infertility; liver disease; lower back pain; obstetric and gynecologic complications; pancreatitis; as well as abdominal hernias; acanthosis nigricans; endocrine abnormalities; chronic hypoxia and hypercapnia; dermatological effects; elephantitis; gastroesophageal reflux; heel spurs; lower extremity edema; mammegaly which causes considerable problems such as bra strap pain, skin damage, cervical pain, chronic odors and infections in the skin folds under the breasts, etc.; large anterior abdominal wall masses, for example abdominal panniculitis with frequent panniculitis, impeding walking, causing frequent infections, odors, clothing difficulties, low back pain; musculoskeletal disease; pseudo tumor cerebri (or benign intracranial hypertension), and sliding hiatal hernia.

In some embodiments, the disease or disorder may be non-alcoholic fatty liver disease.

According to certain embodiments the disease or disorder or other non-desired physiological state may be being of a non-desired weight despite not being obese or overweight. The subject may be of normal weight (this includes but is not limited to subjects who were previously overweight or obese and who wish to prevent a return to an unhealthy weight). A subject may be a subject who desires weight loss, for example female and/or male subjects who desire a change in their appearance. In some cases where the subject is of a normal weight, aspects of the invention may relate to cosmetic treatment rather than to therapeutic treatment.

The invention also provides a method of increasing the energy expenditure of a subject, reducing appetite in a subject (e.g. due to bioactivity at the GLP-1 receptor, rather than being associated with nausea or vomiting), reducing food intake in a subject, reducing calorie intake in a subject, improving insulin release in a subject, improving carbohydrate metabolism in a subject, and/or improving carbohydrate tolerance in a subject, comprising administration of a therapeutically effective amount of a compound, derivative, salt or composition of the invention. Such methods may relate to treating subjects having a pre-diabetic state such as insulin insensitivity or pre-diabetes.

Energy is burned in all physiological processes. The body can alter the rate of energy expenditure directly, by modulating the efficiency of those processes, or changing the number and nature of processes that are occurring. For example, during digestion the body expends energy moving food through the bowel, and digesting food, and within cells, the efficiency of cellular metabolism can be altered to produce more or less heat.

In one aspect, the method of the invention involves manipulation of the arcuate circuitry that alter food intake coordinately and reciprocally alter energy expenditure. Energy expenditure is a result of cellular metabolism, protein synthesis, metabolic rate, and calorie utilization. Thus, in this aspect of the invention, administration of a compound, derivative, salt or composition of the invention results in increased energy expenditure, and decreased efficiency of calorie utilization.

The increase in energy expenditure may manifest as a lessening of the normal reduction in energy expenditure seen following reduced food intake, or it may manifest as an absolute increase in energy expenditure for example by the promotion of increased physical activity levels or by an increase in the basal metabolic rate.

The invention also provides a method for improving a lipid profile in a subject comprising administration of a therapeutically effective amount of a compound, derivative, salt or composition of the invention. The invention also provides a method for alleviating a condition or disorder that can be alleviated by reducing nutrient availability comprising administration of a therapeutically effective amount of a compound, derivative, salt or composition of the invention.

A compound, derivative, salt or composition of the invention may be used for weight control and treatment, for example reduction or prevention of obesity, in particular any one or more of the following: preventing and reducing weight gain; inducing and promoting weight loss; and reducing obesity as measured by the Body Mass Index. A compound, derivative, salt or composition of the invention may be used in maintaining any one or more of a desired body weight, a desired Body Mass Index, a desired appearance and good health.

The present invention may also be used in treating, prevention, ameliorating or alleviating conditions or disorders caused by, complicated by, or aggravated by a relatively high nutrient availability. The term "condition or disorder which can be alleviated by reducing caloric (or nutrient) availability" is used herein to denote any condition or disorder in a subject that is either caused by, complicated by, or aggravated by a relatively high nutrient availability, or that can be alleviated by reducing nutrient availability, for example by decreasing food intake. Subjects who are insulin resistant, glucose intolerant, or have any form of diabetes mellitus, for example, type 1, 2 or gestational diabetes, can also benefit from methods in accordance with the present invention.

Conditions or disorders associated with increased caloric intake include, but are not limited to, insulin resistance, glucose intolerance, obesity, diabetes, including type 2 diabetes, eating disorders, insulin-resistance syndromes, and Alzheimer's disease. J. Cereb. Blood Flow Metab. 2011 Apr. 13 (Teramoto S et al) discusses the use of both GLP-1 and exendin-4 to confer cardioprotection after myocardial infarction and demonstrates that exendin-4 may be used to provide neuroprotection against cerebral ischemia-reperfusion injury. The study showed that mice receiving a transvenous injection of exendin-4, after a 60-minute focal cerebral ischemia showed significantly reduced infarct volume and improved functional deficit as well as suppressed oxidative stress, inflammatory response, and cell death after reperfusion. The study provided evidence that the protective effect of exendin-4 is mediated through increased intracellular cAMP levels and suggested that exendin-4 is potentially useful in the treatment of acute ischemic stroke.

Accordingly, the invention also provides a method of providing cytoprotection in a subject, such as providing cardiac protection, providing neuroprotection and/or treating or preventing neurodegeneration, comprising administration of a therapeutically effective amount of a compound, derivative, salt or composition of the invention.

In certain embodiments the disease or disorder or other non-desired physiological state which the compound, derivative, salt or composition of the invention may be used to treat or prevent is neurodegeneration. Such neurodegeneration may be caused by apoptosis, necrosis or loss of function of neuronal cells, preferably in the CNS. Neurodegeneration treated or prevented may be that following a brain injury (for example following physical trauma or following a non-traumatic injury such a stroke, tumor, hypoxia, poisoning, infection, ischemia, encephalopathy or substance abuse). Alternatively or additionally, neurodegeneration may be prevented or treated in a subject having (or diagnosed as having a predisposition to) a neurodegenerative disease such as Alzheimer's disease, Parkinson's disease, Gehrig's disease (Amyotrophic Lateral Sclerosis), Huntington's disease, Multiple Sclerosis, other demyelination related disorders, senile dementia, subcortical dementia, arteriosclerotic dementia, AIDS-associated dementia, other dementias, cerebral vasculitis, epilepsy, Tourette's syndrome, Guillain Barre Syndrome, Wilson's disease, Pick's disease, neuroinflammatory disorders, encephalitis, encephalomyelitis, meningitis, other central nervous system infections, prion diseases, cerebellar ataxias, cerebellar degeneration, spinocerebellar degeneration syndromes, Friedrich's ataxia, ataxia teangiectasia, spinal dysmyotrophy, progressive supranuclear palsy, dystonia, muscle spasticity, tremor, retinitis pigmentosa, striatonigral degeneration, mitochondrial encephalomyopathies, neuronal ceroid lipofuscinosis. Preferably, the neurodegenerative disease is selected from the group consisting of Alzheimer's disease, Parkinson's disease, Gehrig's disease (Amyotrophic Lateral Sclerosis) and Huntington's disease. In such circumstances the treatment would be regarded as neuroprotective. According to certain preferred embodiments, the treatment is neuroprotective following cerebral ischemia or neuroprotective in a subject having a neurodegenerative disease or diagnosed as having a predisposition to a neurodegenerative disease.

According to other embodiments the disease or disorder or other non-desired physiological state is cardiac degeneration (in particular myocardial degeneration by apoptosis, necrosis or loss of function of myocardial cells), in which case the compound, derivative, salt or composition according to the invention provides cardiac protection. According to certain preferred embodiments that treatment is protective of myocardial function following myocardiac infarction.

The invention also provides a compound, derivative, salt or composition of the invention, for use in the treatment of obesity or diabetes.

The invention also provides a compound, derivative, salt or composition of the invention, for use in increasing energy expenditure of a subject, improving insulin release in a subject, improving carbohydrate tolerance in a subject and/or improving carbohydrate metabolism in a subject. Such use may relate to treating subjects having a pre-diabetic state such as insulin insensitivity or pre-diabetes.

The invention also provides a compound, derivative, salt or composition of the invention, for use in the reduction of appetite in a subject, use in the reduction of food intake in a subject, use in the reduction of calorie intake in a subject, use in improving insulin release in a subject, and/or use in improving carbohydrate tolerance in a subject. Such use may relate to treating subjects having a pre-diabetic state such as insulin insensitivity or pre-diabetes.

The invention also provides a compound, derivative, salt or composition of the invention, for use as a cytoprotective agent (e.g. in treating or preventing neurodegeneration, providing neuroprotection and/or providing cardiac protection). For example, the compound, derivative, salt or composition may be for use in myocardial protection in a subject following myocardial infarction, or for use in neuroprotection in a subject following cerebral ischemia or stroke, or for use in neuroprotection in a subject having a chronic neurodegenerative disease. Various features of neuroprotective or cardioprotective use of the compound, derivative, salt or composition may be as outlined above in relation to methods of the invention.

In the case of neuroprotection, the subject may have experienced previously a brain injury, stroke or other event causing cerebral ischemia. Alternatively, the subject may have or have been diagnosed with a predisposition to develop a chronic neurodegenerative disease. In the case of cardioprotection the subject may have experienced previously an event causing myocardial ischemia such as a myocardial infarction and angina. According to some embodiments a compound, derivative, salt or composition of the invention may be administered as soon as possible after the subject has experienced a suspected myocardial infarction. According to certain embodiments a compound, derivative, salt or composition of the invention may be administered as soon as possible after the subject has experienced as suspected stroke.

The invention also provides use of a compound, derivative, salt or composition of the invention for the manufacture of a medicament for the treatment of obesity or diabetes, of a subject, who may be as described above in reference to other aspects of the invention.

The invention also provides use of a compound, derivative or salt of the invention for the manufacture of a medicament for increasing energy expenditure in a subject, for improving insulin release in a subject, for improving carbohydrate tolerance in a subject and/or improving carbohydrate metabolism in a subject. Such use may relate to treating subjects with a pre-diabetic state such as insulin insensitivity or pre-diabetes.

The invention also provides use of a compound, derivative or salt of the invention for the manufacture of a medicament for the reduction of appetite in a subject, reducing food intake in a subject, reducing calorie intake in a subject, improving insulin release in a subject, and/or use in improving carbohydrate tolerance in a subject.

The invention also provides use of a compound, derivative or salt of the invention for the manufacture of a medicament for providing cytoprotection (e.g. preventing or treating neurodegeneration, providing neuroprotection and/or providing cardiac protection) of a subject, who may be as described above in reference to other aspects of the invention.

According to certain embodiments the compound, derivative, salt or composition of the invention is to be administered parentally. According to other embodiments the compound, derivative, salt or composition of the invention is administered subcutaneously, intravenously, intramuscularly, intranasally, transdermally or sublingually. According to other embodiments the compound, derivative, salt or composition of the invention is administered orally. In one preferred embodiment compound, derivative, salt or composition of the invention is administered subcutaneously.

The compound, derivative, salt or composition of the invention is preferably used in the treatment of a human subject. However, while the compound, derivative, salt or composition of the invention will typically be used to treat human subjects they may also be used to treat similar or identical conditions in other vertebrates for example other primates; farm animals for example swine, cattle and poultry; sport animals for example horses; or companion animals for example dogs and cats.

Compositions

It is preferable for the compound of formula (I), or the derivative and/or the salt thereof, to be present in a pharmaceutical formulation or composition. Accordingly, the invention provides a composition comprising a compound, derivative or salt of the invention together with a pharmaceutically acceptable excipient and optionally another therapeutic ingredient. Compositions comprising the compound, derivative or salt are suitable for pharmaceutical use. According to certain preferred embodiments the composition is present in a syringe or other administration device for subcutaneous administration to humans. According to certain preferred embodiments the composition has a pH of less than 5 and/or the composition comprises zinc ions. Compositions of the invention may take the form of a pharmaceutical formulation as described below.

The pharmaceutical formulations according to the invention include those suitable for oral, parenteral (including subcutaneous, intradermal, intramuscular, intravenous, and intra-articular), inhalation (including fine particle dusts or mists which may be generated by means of various types of metered dose pressurized aerosols, nebulizers or insufflators), rectal and topical (including dermal, transdermal, transmucosal, buccal, sublingual, and intraocular) administration, although the most suitable route may depend upon, for example, the condition and disorder of the recipient.

The formulations may conveniently be presented in unit dosage form and may be prepared by any of the methods well known in the art of pharmacy. All methods include the step of bringing the active ingredient into association with the carrier which constitutes one or more accessory ingredients. In general the formulations are prepared by uniformly and intimately bringing into association the active ingredient with liquid carriers or finely divided solid carriers or both and then, if necessary, shaping the product into the desired formulation.

Formulations of the present invention suitable for oral administration may be presented as discrete units such as capsules, cachets or tablets each containing a predetermined amount of the active ingredient; as a powder or granules; as a solution or a suspension in an aqueous liquid or a non-aqueous liquid; or as an oil-in-water liquid emulsion or a water-in-oil liquid emulsion. The active ingredient may also be presented as a bolus, electuary or paste. Various pharmaceutically acceptable carriers and their formulation are described in standard formulation treatises, e.g., *Remington's Pharmaceutical Sciences* by E. W. Martin. See also Wang, Y. J. and Hanson, M. A., *Journal of Parenteral Science and Technology*, Technical Report No. 10, Supp. 42:2S, 1988, the contents of which are incorporated herein by reference.

A tablet may be made by compression or moulding, optionally with one or more accessory ingredients. Compressed tablets may be prepared by compressing in a suitable machine the active ingredient in a free-flowing form such as a powder or granules, optionally mixed with a binder, lubricant, inert diluent, lubricating, surface active or dispersing agent. Moulded tablets may be made by moulding in a suitable machine a mixture of the powdered compound moistened with an inert liquid diluent. The tablets may optionally be coated or scored and may be formulated so as to provide slow or controlled release of the active ingredient therein. The present compounds can, for example, be administered in a form suitable for immediate release or extended release. Immediate release or extended release can be achieved by the use of suitable pharmaceutical compositions comprising the present compounds or, particularly in the case of extended release, by the use of devices such as subcutaneous implants or osmotic pumps. The present compounds may also be administered liposomally.

Preferably, compositions according to the invention are suitable for subcutaneous administration, for example by injection. According to certain embodiments the composition may contain metal ions, for example copper, iron, aluminium, zinc, nickel or cobalt ions. The presence of such ions may limit solubility and thus delay absorption into the circulatory system from the site of subcutaneous administration.

In a particularly preferred embodiment, the composition contains zinc ions (preferably at a molar ratio of 1:4, 1:2, 1:1, 2:1 or 4:1 of zinc ions to compound, derivative or salt of the invention, or at a ratio which is a range between any two of the whole number ratios given immediately above, e.g. at a molar ratio in the range of from 1:4 to 4:1).

Exemplary compositions for oral administration include suspensions which can contain, for example, microcrystalline cellulose for imparting bulk, alginic acid or sodium alginate as a suspending agent, methylcellulose as a viscosity enhancer, and sweeteners or flavoring agents such as those known in the art; and immediate release tablets which can contain, for example, microcrystalline cellulose, dicalcium phosphate, starch, magnesium stearate and/or lactose and/or other excipients, binders, extenders, disintegrants, diluents and lubricants such as those known in the art. The compounds of the invention may also be delivered through the oral cavity by sublingual and/or buccal administration. Molded tablets, compressed tablets or freeze-dried tablets are exemplary forms which may be used. Exemplary compositions include those formulating the present compound(s) with fast dissolving diluents such as mannitol, lactose, sucrose and/or cyclodextrins. Also included in such formulations may be high molecular weight excipients such as celluloses (avicel) or polyethylene glycols (PEG). Such formulations can also include an excipient to aid mucosal adhesion such as hydroxypropyl cellulose (HPC), hydroxypropyl methyl cellulose (HPMC), sodium carboxy methyl cellulose (SCMC), maleic anhydride copolymer (e.g., Gantrez), and agents to control release such as polyacrylic copolymer (e.g. Carbopol 934). Lubricants, glidants, flavors, coloring agents and stabilizers may also be added for ease of fabrication and use.

Formulations for parenteral administration include aqueous and non-aqueous sterile injection solutions which may contain anti-oxidants, buffers, bacteriostats and solutes which render the formulation isotonic with the blood of the intended recipient; and aqueous and non-aqueous sterile suspensions which may include suspending agents and thickening agents. The formulations may be presented in unit-dose or multi-dose containers, for example sealed ampoules and vials, and may be stored in a freeze-dried (lyophilised) condition requiring only the addition of the sterile liquid carrier, for example saline or water-for-injection, immediately prior to use. Extemporaneous injection solutions and suspensions may be prepared from sterile powders, granules and tablets of the kind previously described. Exemplary compositions for parenteral administration include injectable solutions or suspensions which can contain, for example, suitable non-toxic, parenterally acceptable diluents or solvents, such as mannitol, 1,3-butanediol, water, Ringer's solution, an isotonic sodium chloride solution, or other suitable dispersing or wetting and suspending agents, including synthetic mono- or diglycerides, and fatty acids, including oleic acid, or Cremaphor. An aqueous carrier may be, for example, an isotonic buffer solution at a pH of from about 3.0 to about 8.0, preferably at a pH of from about 3.5 to about 7.4, for example from 3.5 to 6.0, for example from 3.5 to about 5.0. Useful buffers include sodium citrate-citric acid and sodium phosphate-phosphoric acid, and sodium acetate/acetic acid buffers. The composition preferably does not include any compounds known to be deleterious to peptide compounds.

Excipients that can be included are, for instance, other proteins, such as human serum albumin or plasma preparations. If desired, the pharmaceutical composition may also contain minor amounts of non-toxic auxiliary substances, such as wetting or emulsifying agents, preservatives, and pH buffering agents and the like, for example sodium acetate or sorbitan monolaurate.

Exemplary compositions for nasal aerosol or inhalation administration include solutions in saline, which can contain, for example, benzyl alcohol or other suitable preservatives, absorption promoters to enhance bioavailability, and/or other solubilizing or dispersing agents such as those known in the art. Conveniently in compositions for nasal aerosol or inhalation administration the compound of the invention is delivered in the form of an aerosol spray presentation from a pressurized pack or a nebulizer, with the use of a suitable propellant, e.g., dichlorodifluoro-methane, trichlorofluoromethane, dichlorotetrafluoroethane, carbon dioxide or other suitable gas. In the case of a pressurized aerosol the dosage unit can be determined by providing a valve to deliver a metered amount. Capsules and cartridges of e.g. gelatin for use in an inhaler or insufflator can be formulated to contain a powder mix of the compound and a suitable powder base, for example lactose or starch. In one specific, non-limiting example, a compound of the invention is administered as an aerosol from a metered dose valve, through an aerosol adapter also known as an actuator. Optionally, a stabilizer is also included, and/or porous particles for deep lung delivery are included (e.g., see U.S. Pat. No. 6,447,743).

Formulations for rectal administration may be presented as a retention enema or a suppository with the usual carriers such as cocoa butter, synthetic glyceride esters or polyethylene glycol. Such carriers are typically solid at ordinary temperatures, but liquefy and/or dissolve in the rectal cavity to release the drug.

Formulations for topical administration in the mouth, for example buccally or sublingually, include lozenges comprising the active ingredient in a flavoured basis such as sucrose and acacia or tragacanth, and pastilles comprising the active ingredient in a basis such as gelatin and glycerine or sucrose and acacia. Exemplary compositions for topical administration include a topical carrier such as Plastibase (mineral oil gelled with polyethylene).

Preferred unit dosage formulations are those containing an effective dose, as hereinbefore recited, or an appropriate fraction thereof, of the active ingredient.

It should be understood that in addition to the ingredients particularly mentioned above, the formulations of this invention may include other agents conventional in the art having regard to the type of formulation in question, for example those suitable for oral administration may include flavouring agents.

The compounds, derivatives and salts of the invention may also be suitably administered as sustained-release systems. Suitable examples of sustained-release systems of the invention include suitable polymeric materials, for example semi-permeable polymer matrices in the form of shaped articles, e.g., films, or microcapsules; suitable hydrophobic materials, for example as an emulsion in an acceptable oil; or ion exchange resins; and sparingly soluble derivatives of the compound of the invention, for example, a sparingly soluble salt. Sustained-release systems may be administered orally; rectally; parenterally; intracisternally; intravaginally; intraperitoneally; topically, for example as a powder, ointment, gel, drop or transdermal patch; bucally; or as an oral or nasal spray.

Preparations for administration can be suitably formulated to give controlled release of compounds, derivatives and salts of the invention. For example, the pharmaceutical compositions may be in the form of particles comprising one or more of biodegradable polymers, polysaccharide jellifying and/or bioadhesive polymers, amphiphilic polymers, agents capable of modifying the interface properties of particles of the compounds of the invention. These compositions exhibit certain biocompatibility features which allow a controlled release of the active substance, see U.S. Pat. No. 5,700,486, the contents of which are incorporated by reference.

Controlled release of compounds, derivatives and salts of the invention may also be achieved by the use of pharmaceutical compositions comprising zinc ions. As described above, at pH 7.4 but not at pH 5 zinc ions co-ordinate with histidine residues and result in increased precipitation at a subcutaneous injection site. A zinc-containing precipitate will more gradually re-dissolve because the solubilisation is dependent on the zinc washing out of the injection site into the circulation and/or surrounding tissue fluid, increasing the longevity of the release into the circulation. The use of a controlled release composition is preferred for indications such as the treatment of obesity and/or diabetes, where maximising the time period between injections is desirable. However, for indications such as providing neuroprotection or cardiac protection (e.g. following suspected myocardial infarction or stroke), where it is desired to achieve a therapeutic plasma concentration of the active agent in as short a time period as possible, an immediate release formulation will be preferred. In such cases, a dosage regime comprising administration of a dose of an immediate release formulation of the active agent (i.e. as soon as possible after suspected myocardial infarction or stroke) and subsequent administration of a dose of a controlled release formulation of the active agent may be preferred.

A compound, derivative or salt of the invention may be delivered by way of a pump (see Langer, supra; Sefton, *CRC Crit. Ref. Biomed. Eng.* 14:201, 1987; Buchwald et al., *Surgery* 88:507, 1980; Saudek et al., *N. Engl. J. Med.* 321:574, 1989) or by a continuous subcutaneous infusion, for example, using a mini-pump. An intravenous bag solution may also be employed. The key factor in selecting an appropriate dose is the result obtained, as measured by decreases in total body weight or ratio of fat to lean mass, or by other criteria for measuring control or prevention of obesity or prevention of obesity-related conditions, as are deemed appropriate by the practitioner. Other controlled release systems are discussed in the review by Langer (*Science* 249:1527-1533, 1990) which is incorporated herein by reference. In another aspect of the disclosure compounds of the invention are delivered by way of an implanted pump, described, for example, in U.S. Pat. Nos. 6,436,091; 5,939,380; 5,993,414, the contents of which are incorporated herein by reference.

Implantable drug infusion devices are used to provide patients with a constant and long-term dosage or infusion of a drug or any other therapeutic agent. Essentially such device may be categorized as either active or passive. A compound, derivative or salt of the present invention may be formulated as a depot preparation. Such a long acting depot formulation can be administered by implantation, for example subcutaneously or intramuscularly; or by intramuscular injection. Thus, for example, the active ingredient can be formulated with suitable polymeric or hydrophobic materials, for example as an emulsion in an acceptable oil; or ion exchange resins; or as a sparingly soluble derivatives, for example, as a sparingly soluble salt.

A therapeutically effective amount of the active agent of the invention may be administered as a single pulse dose, as a bolus dose, or as pulse doses administered over time. Thus, in pulse doses, a bolus administration of the active agent is provided, followed by a time period wherein no active agent is administered to the subject, followed by a second bolus administration. In specific, non-limiting examples, pulse doses are administered during the course of a day, during the course of a week, or during the course of a month.

Combination Treatments:

In certain embodiments, a therapeutically effective amount of a compound, derivative, salt or composition of the invention is administered with a therapeutically effective amount of a further agent or agents. The compound, derivative or salt may for example be administered simultaneously with one or more further therapeutic agent(s), or it may be administered sequentially or separately. Accordingly, the invention provides a compound, derivative or salt of the invention for use as a medicament, wherein the compound, derivative or salt is for use with a therapeutically effective amount of a further therapeutic agent or agents (e.g. for administration simultaneously, sequentially or separately). In certain embodiments, the active agent of the invention is formulated and administered with a further therapeutic agent or agents as a single dose.

In certain embodiments, the further therapeutic agent or agents is/are an additional anti-diabetic, appetite suppressant, a food-intake-reducing, plasma glucose-lowering or plasma lipid-altering agent. Specific, non-limiting examples of an additional appetite suppressant include amfepramone (diethylpropion), phentermine, mazindol and phenylpropanolamine, fenfluramine, dexfenfluramine, phendimetrazine, benzphetamine, sibutramine, rimonabant, topiramate, fluoxetine, bupropion, zonisamide, naltrexone, orlistat and cetilistat. Specific, non-limiting examples of an additional anti-diabetic agent include metformin, phenformin, rosiglitazone, pioglitazone, troglitazone, repaglinide, nateglinide, tolbutamide, acetohexamide, tolazamide, chlorpropamide, glipizide, glyburide, glimepiride, gliclazide, fibroblast growth factor 21, miglitol, acarbose, exenatide, pramlintide, vildagliptin and sitagliptin.

In alternative embodiments, the further therapeutic agent or agents is/are an additional cardioprotective or neuroprotective agent. Specific, non-limiting, examples of additional cardioprotective agents include aspirin, N-acetylcysteine, phenethylamines, coenzyme Q10, vitamin E, vitamin C, L-carnitine, carvedilol and dexrazoxane. Specific, non-limiting examples of neuroprotective agents include statins such as simvastatin, steroids such as progesterone, minocycline, resveratrol and vitamin E. Examples of agents used for the treatment of Parkinson's disease include anticholinergics, pramipexole, bromocriptine, levodopa, carbidopa, rasagiline, amantadine and ropinirole.

Dosages:

A compound, derivative, salt or composition of the invention may be administered whenever the effect, e.g., appetite suppression, decreased food intake, increased energy expenditure or decreased caloric intake, is desired, or slightly before to whenever the effect is desired, such as, but not limited to, about 10 minutes, about 15 minutes, about 30 minutes, about 60 minutes, about 90 minutes, or about 120 minutes, before the time the effect is desired.

The therapeutically effective amount of the active agent of the invention will be dependent on the molecule utilized, the subject being treated, the severity and type of the affliction, and the manner and route of administration. For example, a therapeutically effective amount of a compound of the invention may vary from about 0.01 µg per kilogram (kg) body weight to about 1 g per kg body weight, for example about 0.1 µg to about 20 mg per kg body weight, for example about 1 µg to about 5 mg per kg body weight, or about 5 µg to about 1 mg per kg body weight.

In one embodiment of the invention, a compound, derivative or salt of the invention may be administered to a subject at from 4 to 1,333 nmol per kg bodyweight, for example from 5 to 1,000 nmol per kg bodyweight, for example at from 10 to 750 nmol per kg bodyweight, for example at from 20 to 500 nmol per kg bodyweight, in particular at from 30 to 240 nmol per kg bodyweight. For a 75 kg subject, such doses correspond to dosages of from 300 nmol to 100 µmol, for example from 375 nmol to 75 µmol, for example from 750 nmol to 56.25 µmol, for example from 1.5 to 37.5 µmol, in particular from 2.25 to 18 mol. The invention also contemplates dosages ranges bounded by any of the specific dosages mentioned herein.

In an alternative embodiment, a compound, derivative or salt of the invention may be administered to a subject at 0.5 to 135 picomole (pmol) per kg body weight, for example 5 to 100 pmol per kg body weight, for example 10 to 90 pmol per kg body weight, for example about 72 pmol per kg body weight. In one specific, non-limiting example, a compound of the invention is administered in a dose of about 1 nmol or more, 2 nmol or more, or 5 nmol or more. In this example, the dose of the compound of the invention is generally not more than 100 nmol, for example, the dose is 90 nmols or less, 80 nmols or less, 70 nmols or less, 60 nmols or less, 50 nmols or less, nmols or less, 30 nmols or less, 20 nmols or less, 10 nmols. For example, a dosage range may comprise any combination of any of the specified lower dose limits with any of the specified upper dose limits. Thus, examples of non-limiting dose ranges of compounds, derivatives and salts of the invention are within the range of from 1 to 100 nmols, from 2 to 90 mols, from 5 to 80 nmols.

In one specific, non-limiting example, from about 1 to about 50 nmol of a compound of the invention is administered, for example about 2 to about 20 nmol, for example about 10 nmol is administered as a subcutaneous injection. The exact dose is readily determined by one of skill in the art based on the potency of the specific compound utilized, the route of delivery of the compound and the age, weight, sex and physiological condition of the subject.

The doses discussed above may be given, for example, once, twice, three-times or four-times a day or once or twice a week. In some embodiments, a dose may be given no more frequently than once a week. Alternatively, they may be given once every 2, 3 or 4 days. According to certain embodiments they may be administered once shortly before each meal to be taken.

EXAMPLES

The invention is further described with reference to the following non-limiting examples.
Materials and Methods:
Peptide Synthesis Peptide synthesis was carried out on a tricyclic amide linker resin. Amino acids were attached using the Fmoc strategy. For the portion of the molecule from Xaa1 to Xaa45, each amino acid was added sequentially from the C- to the N-termini. Peptide couplings were mediated using reagents such as TBTU. Peptide cleavage from the resin was achieved with trifluoroacetic acid in the presence of scavengers. In a second stage, the lysine 42 residue was functionalised at its ε-amino group following deprotection of the ε-amino group. The chain on the lysine 42 residue was then constructed sequentially using the same amino acid attachment chemistry.

Peptides were purified by reverse phase HPLC. Quality control was performed on all purified peptides and peptides were shown in most cases to be greater than 90% pure by HPLC in two buffer systems. MALDI-MS showed the expected molecular ion.

Example Synthesis

Example compound 366 was prepared as follows using standard Fmoc chemistry:
1. Resin preparation: To 2Cl-Trt Resin (0.30 mmol, 1.00 eq) was added FMOC-LYS(DDE)-OH (159.78 mg, 300.00 umol, 1.00 eq) and DIEA (232.63 mg, 1.80 mmol, 313.52 uL, 6.00 eq) in DCM (10.0 mL). The mixture was agitated with $N_2$ for 2 h at 20° C., then added MeOH (0.3 mL) and agitated with $N_2$ for another 30 min. The resin was washed with DMF (15.0 mL*3). Then 20% piperidine in DMF (5.00 mL) was added and the mixture was agitated with $N_2$ for 30 min at 20° C. Then the mixture was filtered to get the resin. The resin was washed with DMF (15.0 mL*5) and filtered to get the resin.
FMOC-LYS(DDE)-OH has the structure:

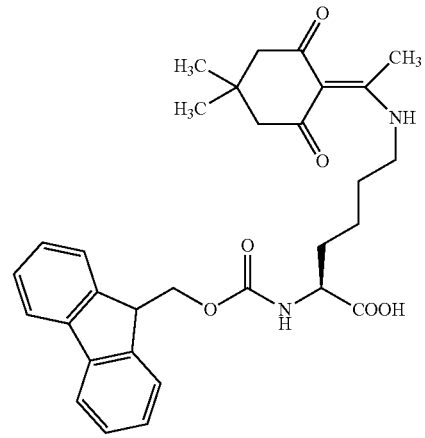 [SMILES: CC(NCCCC[C@H](NC(=O)OCC1c2ccccc2-c2ccccc21)C(=O)O)=C1C(=O)CC(C)(C)CC1=O]

The free acid is attached to the resin. The piperidine deprotection removes the FMOC group and creates a free amino end group for the next coupling.
2. Coupling: a solution of FMOC-PRO-OH (303.66 mg, 900.00 µmol, 3.00 eq), DIEA (232.63 mg, 1.80 mmol, 313.52 µL, 6.00 eq) and HBTU (324.25 mg, 855.00 µmol, 2.85 eq) in DMF (5.00 mL) was added to the resin and agitated with $N_2$ for 30 min at 20° C. The resin was then washed with DMF (15.0 mL*3).
3. Deprotection: 20% piperidine in DMF (5.00 mL) was added to the resin and the mixture was agitated with $N_2$ for 30 min at 20° C. The resin was washed with DMF (15.0 mL*5) and filtered to get the resin.
4. Steps 2-3 were repeated using the reagents in Table 1 until the last amino acid had been added (reaction iteration #1 in Table 1 is the first added Pro residue, as set out in steps 2 and 3 above).

TABLE 1

| # | Materials | Coupling reagents |
|---|---|---|
| 1 | FMOC-PRO-OH (3.00 eq) | HBTU (2.85 eq) and DIEA (6.00 eq) |
| 2 | FMOC-PRO-OH (3.00 eq) | HBTU (2.85 eq) and DIEA (6.00 eq) |
| 3 | FMOC-SER(TBU)-OH (3.00 eq) | HBTU (2.85 eq) and DIEA (6.00 eq) |
| 4 | FMOC-PRO-OH (3.00 eq) | HBTU (2.85 eq) and DIEA (6.00 eq) |
| 5 | FMOC-HIS(TRT)-OH (3.00 eq) | HBTU (2.85 eq) and DIEA (6.00 eq) |
| 6 | FMOC-HIS(TRT)-OH (3.00 eq) | HBTU (2.85 eq) and DIEA (6.00 eq) |
| 7 | FMOC-GLN(TRT)-OH (3.00 eq) | HBTU (2.85 eq) and DIEA (6.00 eq) |
| 8 | FMOC-HIS(TRT)-OH (3.00 eq) | HBTU (2.85 eq) and DIEA (6.00 eq) |
| 9 | FMOC-HIS(TRT)-OH (3.00 eq) | HBTU (2.85 eq) and DIEA (6.00 eq) |
| 10 | FMOC-SER(TBU)-OH (3.00 eq) | HBTU (2.85 eq) and DIEA (6.00 eq) |
| 11 | FMOC-GLN(TRT)-OH (3.00 eq) | HBTU (2.85 eq) and DIEA (6.00 eq) |
| 12 | FMOC-LEU-OH (3.00 eq) | HBTU (2.85 eq) and DIEA (6.00 eq) |
| 13 | FMOC-LEU-OH (3.00 eq) | HBTU (2.85 eq) and DIEA (6.00 eq) |
| 14 | FMOC-TRP(BOC)-OH (3.00 eq) | HBTU (2.85 eq) and DIEA (6.00 eq) |
| 15 | FMOC-GLU(OTBU)-OH (3.00 eq) | HBTU (2.85 eq) and DIEA (6.00 eq) |
| 16 | FMOC-ILE-OH (3.00 eq) | HBTU (2.85 eq) and DIEA (6.00 eq) |
| 17 | FMOC-PHE-OH (3.00 eq) | HBTU (2.85 eq) and DIEA (6.00 eq) |
| 18 | FMOC-GLU(OTBU)-OH (3.00 eq) | HBTU (2.85 eq) and DIEA (6.00 eq) |
| 19 | FMOC-GLN(TRT)-OH (3.00 eq) | HBTU (2.85 eq) and DIEA (6.00 eq) |
| 20 | FMOC-ALA-OH (3.00 eq) | HBTU (2.85 eq) and DIEA (6.00 eq) |
| 21 | FMOC-ARG(PBF)-OH (3.00 eq) | HBTU (2.85 eq) and DIEA (6.00 eq) |
| 22 | FMOC-LYS(BOC)-OH (3.00 eq) | HBTU (2.85 eq) and DIEA (6.00 eq) |
| 23 | FMOC-ALA-OH (3.00 eq) | HBTU (2.85 eq) and DIEA (6.00 eq) |
| 24 | FMOC-ASP(OTBU)-OH (3.00 eq) | HBTU (2.85 eq) and DIEA (6.00 eq) |
| 25 | FMOC-LEU-OH (3.00 eq) | HBTU (2.85 eq) and DIEA (6.00 eq) |
| 26 | FMOC-TYR(TBU)-OH (3.00 eq) | HBTU (2.85 eq) and DIEA (6.00 eq) |
| 27 | FMOC-LYS(BOC)-OH (3.00 eq) | HBTU (2.85 eq) and DIEA (6.00 eq) |
| 28 | FMOC-SER(TBU)-OH (3.00 eq) | HBTU (2.85 eq) and DIEA (6.00 eq) |
| 29 | FMOC-TYR(TBU)-OH (3.00 eq) | HBTU (2.85 eq) and DIEA (6.00 eq) |
| 30 | FMOC-ASP(OTBU)-OH (3.00 eq) | HBTU (2.85 eq) and DIEA (6.00 eq) |
| 31 | FMOC-SER(TBU)-OH (3.00 eq) | HBTU (2.85 eq) and DIEA (6.00 eq) |
| 32 | FMOC-THR(TBU)-OH (3.00 eq) | HBTU (2.85 eq) and DIEA (6.00 eq) |
| 33 | FMOC-PHE-OH (3.00 eq) | HBTU (2.85 eq) and DIEA (6.00 eq) |
| 34 | FMOC-THR(TBU)-OH (3.00 eq) | HBTU (2.85 eq) and DIEA (6.00 eq) |
| 35 | FMOC-GLY-OH (3.00 eq) | HBTU (2.85 eq) and DIEA (6.00 eq) |
| 36 | FMOC-HIS(TRT)-OH (3.00 eq) | HBTU (2.85 eq) and DIEA (6.00 eq) |
| 37 | FMOC-AIB-OH (3.00 eq) | HBTU (2.85 eq) and DIEA (6.00 eq) |
| 38 | FMOC-HIS(TRT)-OH (3.00 eq) | HATU (2.85 eq) and DIEA (6.00 eq) |
| 39 | tert-butoxycarbonyl tert-butyl carbonate (3.00 eq) | DIEA (6.00 eq) |

5. After the coupling of tert-butoxycarbonyl tert-butyl carbonate in iteration #39, 3% $H_2N \cdot NH_2$/DMF was added and reacted for 30 min to remove Dde, and then repeated. The mixture was then drained and washed with DMF (20.0 mL) for 5 times. After removal of the Dde group, the compound has a free amino end group at the ε-amino group of the lysine from step 1 and that is available for the next coupling.

6. The reactions of steps 2-3 were then carried out using the reagents in Table 2 until the last reagent has been added (reaction iteration #44 in Table).

TABLE 2

| # | Materials | Coupling reagents |
|---|---|---|
| 41 | FMOC-SER(TBU)-OH (3.00 eq) | HBTU (2.85 eq) and DIEA (6.00 eq) |
| 42 | FMOC-GLY-OH (3.00 eq) | HBTU (2.85 eq) and DIEA (6.00 eq) |
| 43 | FMOC-GLU-OTBU (3.00 eq)* | HBTU (2.85 eq) and DIEA (6.00 eq) |
| 44 | 18-(tert-butoxy)-18-oxooctadecanoic acid (3.00 eq) | HBTU (2.85 eq) and DIEA (6.00 eq) |

*As the protected glutamic acid reagent 43 has its C-1 acid group protected with TBU, it reacts at its C-5 acid with the previous residue (Gly). It is the FMOC-GLU-OTBU reagent that provides the glutamic acid residue portion in the Z part of the compound when Z is (i):

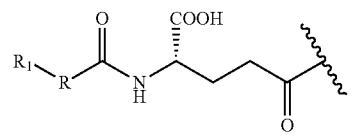

7. Peptide Cleavage and Purification:

The resin was washed with MeOH (30.0 mL*2) and dried under vacuum to provide 2.20 g peptide resin. Then 25.0 mL of cleavage buffer (92.5% TFA/2.5% Mpr/ 2.5% TIS/2.5% $H_2O$) was added to the flask containing the side chain protected peptide resin at 20° C. and the mixture was stirred for 2 h. The peptide was precipitated with cold tert-butyl methylether (300 mL) and centrifuged (3 min at 5000 rpm). The peptide precipitate was washed with tert-butyl methyl ether for two more times (150 mL). The crude peptide was dried and the identity confirmed by LCMS.

The residue was purified by prep-HPLC (TFA condition; 30° C., A:0.075% TFA/$H_2O$, B:$CH_3CN$) to give the title compound (136 mg, 24.82 µmol, 8.27% yield, 98.92% purity, TFA) as a white solid the identity of which was confirmed by LCMS).

Equivalent methods were employed for all of the other peptides described herein. The sequences and other structural features of the exemplified peptides are shown in FIG. 1 and FIG. 2. In the figures, the Lysine residue at position 42 is substituted on its r amino group by Z-Xaa45-Xaa46-Xaa47-Xaa48- [SEQ ID NO: 745] wherein Xaa45, Xaa46, Xaa47 and Xaa48 has the meaning shown (blank in the column in question means that the residue is absent), and Z is a group indicated in column "Z" as having the structure:

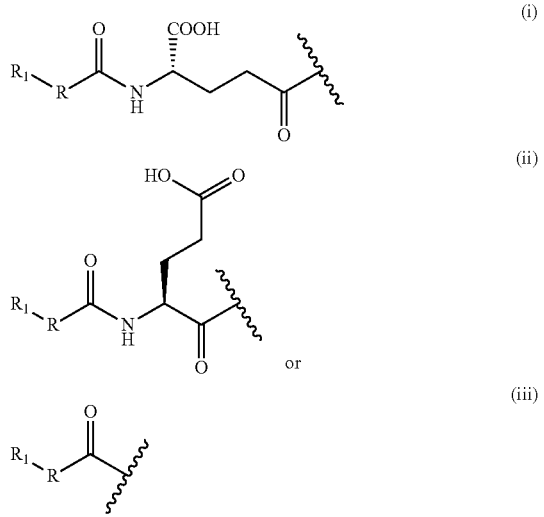

wherein R is a straight chain alkylene group containing n carbon atoms; and
$R^1$ is $CO_2H$.

The value of n is indicated in the column headed "n (R=Cn)" in FIGS. 1 and 2. In the examples shown, n is 12, 14, 16, 18, 20 or 22.

Certain of the example compounds in FIGS. 1 and 2 are chloride or acetate salts and they are indicated as such in the column headed 'Notes'. Certain of the example compounds in FIGS. 1 and 2 were duplicate preparations of compounds listed elsewhere in the Figures and they are indicated as such as "Dupl" in the column headed 'Notes'.

Receptor Potency of Peptides at the Human GLP-1 and Glucagon Receptors, Overexpressed in CHO Cells Biological activity was assessed by potency of peptides to stimulate cAMP production in Chinese Hamster Ovary (CHO) cell lines overexpressing the human GLP-1 or the human glucagon receptor. Cells were plated at a density of $8 \times 10^{-5}$ cells/mL in media (DMEM containing 0.1% v/v BSA, 0.05 IBMX), into 96 well half area plates, on the day of the assay. A commercial cAMP kit (Cisbio) was used to quantify cAMP in the cell via HTRF (Homogeneous Time-Resolved Fluorescence) technology after 30 mins of peptide stimulation and a further 1 h lysis. Plates were read on a SpectraMax i3x Multi-Mode Detection Platform plate reader and concentration response curves drawn with Graph Pad Prism. $EC_{50}$ values were generated for each peptide and compared to the controls for the day to provide an $EC_{50}$ ratio for the compound compared with GLP-1 or glucagon control respectively. (e.g. a value of 0.5 for the GLP-1 $EC_{50}$ ratio would indicate that the concentration of the example compound required to stimulate 50% maximum release of cAMP is half the concentration of native GLP-1 that is required, and a value of 2 would indicate that the concentration of the example compound required to stimulate 50% maximum release of cAMP is 2 times that of native GLP-1). For each peptide, the ratio of its $EC_{50}$ ratio to Glucagon was compared with its $EC_{50}$ ratio to GLP-1, to provide a Glucagon:GLP-1 receptor potency ratio. As a lower $EC_{50}$ ratio is indicative of higher activity, the Glucagon:GLP-1 receptor potency ratio is calculated as $EC_{50}$ (GLP-1)/$EC_{50}$ (Glucagon). Thus, a value of >1 indicates a relatively higher activity (and lower $EC_{50}$) at the glucagon receptor compared with the GLP-1 receptor.

In Vivo Efficacy Study: Single Dose Feeding Studies in Male Wistar Rats

Male Wistar rats (Charles River Ltd, Margate, UK) were used for animal experiments. Ad libitum fed rats were individually housed in IVC cages. Animals were randomised into treatment groups, with stratification by body weight. All peptide solutions were prepared freshly immediately prior to administration. The control animals were dosed water 5% v/v water and 95% NaCl (0.9% w/v) whilst peptides (either 7.5, 15 or 30 nmol/kg body weight) were resuspended in water for injection. Peptide and vehicle were administered in the early light phase (0900-1000) by subcutaneous injection and animals provided a known amount of food. Animals were given free access to food and water during the study period. Animal body weight and remaining food were weighed throughout the study, typically 24, 48, 72, 96 and 168 h post dosing. The results presented are the figures for 7 days (168 h) post dosing.

Results are calculated by comparison of individual rats' food intake and change of body weight with the mean change in saline control animals and expressed as treatment group average (mean). For example a food intake value of '−16' represents an average of a 16 g reduction of food intake compared to the average food intake of control animals in the study for the same time interval. The results for Example compounds 1 to 405 are presented in FIG. 1 in the columns headed "7.5 nM single", "15 nM single" and "30 nM single".

The results for Example compounds 406 to 737 are shown in FIG. 2. The rats were dosed with a single subcutaneous injection of peptide. The dose was generally 7.5 nmol/kg body weight, but on some occasions a dose of 1.5 nmol/kg, 2.0 nmol/kg, 3 nmol/kg, 5 nmol/kg or 6 nmol/kg was used. In the Table in FIG. 2, column 'n' shows the number of times the compound in question was tested. Each test generally involved the compound being given to a group of 5 animals. The compounds were assessed for their ability to bring about body weight change, called in FIG. 2 "potency", and for their propensity to inhibit food intake, called in FIG. 2 "food". The compounds were compared with semaglutide/Ozempic. For "potency", a score of 7 means that the compound causes the same effect as Ozempic. A score above 7 indicates that there is greater weight loss than achieved by the same dose of Ozempic or similar weight loss achieved at a lower dose of Ozempic. For "food", a score of 0 means that the reduction in food intake is the same as for Ozempic. A score above 0 indicates that there is less food intake reduction for the given body weight change than that achieved by Ozempic. A high score therefore indicates that an analogue achieves good weight loss with minimal food intake reduction.

In Vivo Efficacy Study: Repeat Dose Feeding Studies in Male Wistar Rats

In the studies, ab libitum fed male Wistar rats (Charles River) received a total of five subcutaneous injections of saline or example peptide of the invention over a 10 day period, a single injection on each of study days 1, 3, 6, 8 and 10. Within a study the dose level was fixed, ranging between 2 to 5 nmol/kg in different studies. The comparator compound was Semaglutide and it was administered at a dose of 2 to 4 nmol/kg. Interval and total food intake from study day 1 to 12 and body weight change over the same period was calculated. The results for Example compounds 1 to 405 for which these data are available are presented in FIG. 1 in the columns headed "rpt dose".

The average weight loss of rats following repeat dosing was compared to weight loss after administration of Ozempic (Semaglutide) and vehicle controls. Due to actual weight loss varying between cohorts of animals and individual studies, the results are presented as an average response in comparison to Ozempic ranging from 0 to 12, where '7'=same weight loss as Ozempic on study day 12; less the '7' (down to '0')=less weight loss than Ozempic and more than '7' (up to '12')=more weight loss than Ozempic.

The average food intake of rats following repeat dosing was compared to food intake after administration of Ozempic (Semaglutide) and vehicle controls. Due to food intake varying between cohorts of animals and individual studies, the results are presented as an average response in comparison to Ozempic and vehicle controls ranging from 0 to 12, where '0'=same food intake inhibition as Ozempic (large amount of inhibition), '8'=no inhibition of food intake compared to vehicle controls on study day 12 and '12'=greater food intake than vehicle controls on study day 12. Values between '0' and '8' and '8' and '12' represent gradations between the '0', '8' and '12' fixed points.

PK Measurements for Half Life Assessment

Male large white pigs receive a single subcutaneous injection of the test compound at the start of study (0 hours). Repeated blood samples were taken from the pig over the proceeding 168 hours and plasma separated and stored at −20 to −80° C. Plasma concentration of the test compound was quantified using a radioimmunoassay or mass spectrum analysis. Time taken from tmax to half of Cmax was calculated and represents the half-life (t½) of the compound. Typically, the presented t½ is the mean of four separate animals.

Results

FIGS. 1 and 2 are tables providing amino acid sequences and other structural information for the example compounds of the invention. For example, the amino acid sequence of example compound no. 1 is as follows [SEQ ID NO: 1]:

```
His AIB His Gly Thr Phe Thr Ser Asp Tyr Ser Arg

Tyr Leu Asp Glu Arg Arg Ala Gln Glu Phe Ile Glu

Trp Leu Leu Ala Ser His His His His Pro Ser

Pro Pro Pro Ser Gly Lys Ser Trp
```

And the Lys residue at position 42 carries on its ε-amino group a group Z, where Z is

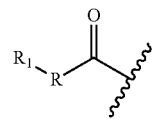

(iii)

wherein R is a $C_{14}$ straight chain alkylene group and $R^1$ is $CO_2H$.

The figure also summarises the results of the in vivo feeding efficacy studies with the example peptides of the invention as discussed above.

In the far right hand column, the figure shows receptor potency data for example peptides at the human glucagon and GLP-1 receptors, overexpressed in Chinese hamster ovary (CHO) cells. Biological activity was assessed by the potency of peptides to stimulate cAMP production in the CHO cells as described above. The value provided for each example compound is the Glucagon: GLP-1 activity ratio.

As can be seen from the figure, rats which were given free access to food and which were administered example peptides of the invention, achieved reduced weight gain or achieved weight loss compared with rats which were administered saline. This supports that the compounds of the invention are particularly effective at improving metabolism, and that they find use in the therapy of disorders such as obesity. However, the amount of food consumed by rats which were administered the example peptides was similar to or greater than the amount of food consumed by rats which were administered saline. The absence of, or only minimal, effect on amount of food ingested supports that the compounds have reduced side effects relating to nausea. As discussed above, rodents are not able to vomit, but those experiencing nausea are likely to be put off from consuming food. With the peptides of the invention, there was no observed evidence of the animals being put off consuming food.

Half Life:

The half-life of a selection of compounds of the invention was measured. The results for the 'Group I' set of example compounds was as follows:

| Example | Compound Ref | Half life/hrs |
|---|---|---|
| Semaglutide | | 56 |
| 507 | G5943 | 112 |
| 544 | G6070 | 83 |
| 549 | G6077 | 110 |
| 587 | G6129 | 84 |
| 588 | G6130 | 65 |
| 640 | G6204 | 135 |
| 642 | G6213 | 109 |
| 646 | G6218 | 42 |
| 647 | G6219 | 106 |
| 649 | G6221 | 84 |
| 652 | G6224 | 116 |
| 701 | G6363 | 66 |
| 704 | G6368 | 96 |
| 705 | G6370 | 84 |
| 706 | G6372 | 110 |
| 707 | G6373 | 103 |
| 708 | G6374 | 105 |

Where in the foregoing description, integers or elements are mentioned which have known, obvious or foreseeable equivalents, then such equivalents are herein incorporated as if individually set forth. Reference should be made to the

SEQUENCE LISTING (815 sequences)

SEQ ID NO: 1 - protein, 44 aa, Artificial Sequence
  Component of peptide hormone analogue
  MOD_RES (2)..(2): Aib
  MOD_RES (42)..(42): The residue at this position is Lys modified with a Y2 group attached to its epsilon amino group
HXHGTFTSDYSRYLDERRAQEFIEWLLASHHHHHPSPPPSGKSW

SEQ ID NO: 2 - protein, 38 aa, Artificial Sequence
  Component of peptide hormone analogue
  MOD_RES (2)..(2): Aib
  MOD_RES (38)..(38): The residue at this position is Lys modified with a Y2 group attached to its epsilon amino group
HXHGTFTSDYSKYLDEKKAHEFIEWLLASHHHHHPSGK

SEQ ID NO: 3 - protein, 38 aa, Artificial Sequence; identical to SEQ ID NO: 2
  Component of peptide hormone analogue
  MOD_RES (2)..(2): Aib
  MOD_RES (38)..(38): The residue at this position is Lys modified with a Y2 group attached to its epsilon amino group

SEQ ID NO: 4 - protein, 38 aa, Artificial Sequence; identical to SEQ ID NO: 2
  Component of peptide hormone analogue
  MOD_RES (2)..(2): Aib
  MOD_RES (38)..(38): The residue at this position is Lys modified with a Y2 group attached to its epsilon amino group

SEQ ID NO: 5 - protein, 38 aa, Artificial Sequence; identical to SEQ ID NO: 2
  Component of peptide hormone analogue
  MOD_RES (2)..(2): Aib
  MOD_RES (38)..(38): The residue at this position is Lys modified with a Y2 group attached to its epsilon amino group

SEQ ID NO: 6 - protein, 39 aa, Artificial Sequence
  Component of peptide hormone analogue
  MOD_RES (2)..(2): Aib
  MOD_RES (39)..(39): The residue at this position is Lys modified with a Y2 group attached to its epsilon amino group
HXHGTFTSDYSRYLDERRAQEFIEWLLTGHHHHHASGSK

SEQ ID NO: 7 - protein, 39 aa, Artificial Sequence; identical to SEQ ID NO: 6
  Component of peptide hormone analogue
  MOD_RES (2)..(2): Aib
  MOD_RES (39)..(39): The residue at this position is Lys modified with a Y2 group attached to its epsilon amino group

SEQ ID NO: 8 - protein, 39 aa, Artificial Sequence; identical to SEQ ID NO: 6
  Component of peptide hormone analogue
  MOD_RES (2)..(2): Aib
  MOD_RES (39)..(39): The residue at this position is Lys modified with a Y2 group attached to its epsilon amino group

SEQ ID NO: 9 - protein, 39 aa, Artificial Sequence
  Component of peptide hormone analogue
  MOD_RES (2)..(2): Aib
  MOD_RES (39)..(39): The residue at this position is Lys modified with a Y2 group attached to its epsilon amino group
HXHGTFTSDYSRYLDERRAQEFIEWLLTGHHHHHASGGK

SEQ ID NO: 10 - protein, 38 aa, Artificial Sequence
  Component of peptide hormone analogue
  MOD_RES (2)..(2): Aib
  MOD_RES (38)..(38): The residue at this position is Lys modified with a Y2 group attached to its epsilon amino group
HXHGTFTSDYSRYLDERRAQEFIEWLLTGHHHHHASGK

SEQ ID NO: 11 - protein, 41 aa, Artificial Sequence
  Component of peptide hormone analogue
  MOD_RES (2)..(2): Aib
  MOD_RES (41)..(41): The residue at this position is Lys modified with a Y2 group attached to its epsilon amino group
HXHGTFTSDYSRYLDERRAQEFIEWLLASHHHHHPSPPPGK

SEQ ID NO: 12 - protein, 41 aa, Artificial Sequence; identical to SEQ ID NO: 11
  Component of peptide hormone analogue
  MOD_RES (2)..(2): Aib
  MOD_RES (41)..(41): The residue at this position is Lys modified with a Y2 group attached to its epsilon amino group

SEQ ID NO: 13 - protein, 41 aa, Artificial Sequence; identical to SEQ ID NO: 11
  Component of peptide hormone analogue
  MOD_RES (2)..(2): Aib
  MOD_RES (41)..(41): The residue at this position is Lys modified with a Y2 group attached to its epsilon amino group

SEQ ID NO: 14 - protein, 39 aa, Artificial Sequence
  Component of peptide hormone analogue
  MOD_RES (2)..(2): Aib
  MOD_RES (39)..(39): The residue at this position is Lys modified with a Y2 group attached to its epsilon amino group
HXHGTFTSDYSRYLDERRAQEFIEWLLASHHHHHPSPGK

SEQ ID NO: 15 - protein, 39 aa, Artificial Sequence; identical to SEQ ID NO: 14
  Component of peptide hormone analogue
  MOD_RES (2)..(2): Aib
  MOD_RES (39)..(39): The residue at this position is Lys modified with a Y2 group attached to its epsilon amino group

SEQ ID NO: 16 - protein, 42 aa, Artificial Sequence
  Component of peptide hormone analogue
  MOD_RES (2)..(2): Aib
  MOD_RES (42)..(42): The residue at this position is Lys modified with a Y2 group attached to its epsilon amino group
HXHGTFTSDYSRYLDERRAQEFIEWLLASHHHHHPSPPPGSK

SEQ ID NO: 17 - protein, 42 aa, Artificial Sequence; identical to SEQ ID NO: 16
  Component of peptide hormone analogue
  MOD_RES (2)..(2): Aib
  MOD_RES (42)..(42): The residue at this position is Lys modified with a Y2 group attached to its epsilon amino group

SEQ ID NO: 18 - protein, 39 aa, Artificial Sequence; identical to SEQ ID NO: 9
  Component of peptide hormone analogue
  MOD_RES (2)..(2): Aib
  MOD_RES (39)..(39): The residue at this position is Lys modified with a Y2 group attached to its epsilon amino group

SEQ ID NO: 19 - protein, 39 aa, Artificial Sequence
  Component of peptide hormone analogue
  MOD_RES (2)..(2): Aib
  MOD_RES (39)..(39): The residue at this position is Lys modified with a Y2 group attached to its epsilon amino group
HXHGTFTSDYSKYLDAKRAQEFIEWLLQSHHHHHSGEGK

SEQ ID NO: 20 - protein, 39 aa, Artificial Sequence; identical to SEQ ID NO: 19
  Component of peptide hormone analogue
  MOD_RES (2)..(2): Aib
  MOD_RES (39)..(39): The residue at this position is Lys modified with a Y2 group attached to its epsilon amino group

SEQ ID NO: 21 - protein, 39 aa, Artificial Sequence; identical to SEQ ID NO: 19
  Component of peptide hormone analogue
  MOD_RES (2)..(2): Aib
  MOD_RES (39)..(39): The residue at this position is Lys modified with a Y2 group attached to its epsilon amino group

SEQ ID NO: 22 - protein, 42 aa, Artificial Sequence; identical to SEQ ID NO: 16
  Component of peptide hormone analogue
  MOD_RES (2)..(2): Aib
  MOD_RES (42)..(42): The residue at this position is Lys modified with a Y2 group attached to its epsilon amino group

SEQ ID NO: 23 - protein, 39 aa, Artificial Sequence; identical to SEQ ID NO: 9
  Component of peptide hormone analogue
  MOD_RES (2)..(2): Aib
  MOD_RES (39)..(39): The residue at this position is Lys modified with a Y2 group attached to its epsilon amino group

SEQ ID NO: 24 - protein, 38 aa, Artificial Sequence
  Component of peptide hormone analogue
  MOD_RES (2)..(2): Aib
  MOD_RES (38)..(38): The residue at this position is Lys modified with a Y2 group attached to its epsilon amino group
HXHGTFTSDYSRYLDQKRAQEFIEWLLATHHHHHPSGK

SEQ ID NO: 25 - protein, 38 aa, Artificial Sequence; identical to SEQ ID NO: 24
  Component of peptide hormone analogue
  MOD_RES (2)..(2): Aib
  MOD_RES (38)..(38): The residue at this position is Lys modified with a Y2 group attached to its epsilon amino group

SEQ ID NO: 26 - protein, 38 aa, Artificial Sequence
  Component of peptide hormone analogue
  MOD_RES (2)..(2): Aib
  MOD_RES (38)..(38): The residue at this position is Lys modified with a Y2 group attached to its epsilon amino group
HXHGTFTSDYSRYLDERRAQEFIEWLLASHHHHHPSPK

SEQ ID NO: 27 - protein, 38 aa, Artificial Sequence; identical to SEQ ID NO: 26
  Component of peptide hormone analogue
  MOD_RES (2)..(2): Aib
  MOD_RES (38)..(38): The residue at this position is Lys modified with a Y2 group attached to its epsilon amino group

SEQ ID NO: 28 - protein, 38 aa, Artificial Sequence; identical to SEQ ID NO: 26
  Component of peptide hormone analogue
  MOD_RES (2)..(2): Aib
  MOD_RES (38)..(38): The residue at this position is Lys modified with a Y2 group attached to its epsilon amino group

SEQ ID NO: 29 - protein, 44 aa, Artificial Sequence; identical to SEQ ID NO: 1
  Component of peptide hormone analogue
  MOD_RES (2)..(2): Aib
  MOD_RES (42)..(42): The residue at this position is Lys modified with a Y2 group attached to its epsilon amino group

SEQ ID NO: 30 - protein, 44 aa, Artificial Sequence; identical to SEQ ID NO: 1
  Component of peptide hormone analogue
  MOD_RES (2)..(2): Aib
  MOD_RES (42)..(42): The residue at this position is Lys modified with a Y2 group attached to its epsilon amino group

SEQ ID NO: 31 - protein, 38 aa, Artificial Sequence
  Component of peptide hormone analogue
  MOD_RES (2)..(2): Aib
  MOD_RES (38)..(38): The residue at this position is Lys modified with a Y2 group attached to its epsilon amino group
HXHGTFTSDYSRYLDERRAQEFIEWLLHGHHHHHPSGK

SEQ ID NO: 32 - protein, 39 aa, Artificial Sequence
  Component of peptide hormone analogue
  MOD_RES (2)..(2): Aib
  MOD_RES (39)..(39): The residue at this position is Lys modified with a Y2 group attached to its epsilon amino group
HXHGTFTSDYSRYLDERRAQEFIEWLLASHHHHHPSPPK

SEQ ID NO: 33 - protein, 39 aa, Artificial Sequence
  Component of peptide hormone analogue
  MOD_RES (2)..(2): Aib
  MOD_RES (39)..(39): The residue at this position is Lys modified with a Y2 group attached to its epsilon amino group
HXHGTFTSDYSRYLDQRRAQEFIEWLLATHHHHHSGEGK

SEQ ID NO: 34 - protein, 38 aa, Artificial Sequence; identical to SEQ ID NO: 24
  Component of peptide hormone analogue
  MOD_RES (2)..(2): Aib
  MOD_RES (38)..(38): The residue at this position is Lys modified with a Y2 group attached to its epsilon amino group

SEQ ID NO: 35 - protein, 38 aa, Artificial Sequence; identical to SEQ ID NO: 31
  Component of peptide hormone analogue
  MOD_RES (2)..(2): Aib
  MOD_RES (38)..(38): The residue at this position is Lys modified with a Y2 group attached to its epsilon amino group

SEQ ID NO: 36 - protein, 44 aa, Artificial Sequence; identical to SEQ ID NO: 1
  Component of peptide hormone analogue
  MOD_RES (2)..(2): Aib
  MOD_RES (42)..(42): The residue at this position is Lys modified with a Y2 group attached to its epsilon amino group

SEQ ID NO: 37 - protein, 44 aa, Artificial Sequence; identical to SEQ ID NO: 1
  Component of peptide hormone analogue
  MOD_RES (2)..(2): Aib
  MOD_RES (42)..(42): The residue at this position is Lys modified with a Y2 group attached to its epsilon amino group

SEQ ID NO: 38 - protein, 44 aa, Artificial Sequence; identical to SEQ ID NO: 1
  Component of peptide hormone analogue
  MOD_RES (2)..(2): Aib
  MOD_RES (42)..(42): The residue at this position is Lys modified with a Y2 group attached to its epsilon amino group

SEQ ID NO: 39 - protein, 42 aa, Artificial Sequence; identical to SEQ ID NO: 16
  Component of peptide hormone analogue
  MOD_RES (2)..(2): Aib
  MOD_RES (42)..(42): The residue at this position is Lys modified with a Y2 group attached to its epsilon amino group

SEQ ID NO: 40 - protein, 39 aa, Artificial Sequence; identical to SEQ ID NO: 6
  Component of peptide hormone analogue
  MOD_RES (2)..(2): Aib
  MOD_RES (39)..(39): The residue at this position is Lys modified with a Y2 group attached to its epsilon amino group

SEQ ID NO: 41 - protein, 38 aa, Artificial Sequence
  Component of peptide hormone analogue
  MOD_RES (2)..(2): Aib
  MOD_RES (38)..(38): The residue at this position is Lys modified with a Y2 group attached to its epsilon amino group
HXHGTFTSDYSKYLDAKRAQEFIEWLLQGHHHHHPSGK

SEQ ID NO: 42 - protein, 44 aa, Artificial Sequence; identical to SEQ ID NO: 1
  Component of peptide hormone analogue
  MOD_RES (2)..(2): Aib
  MOD_RES (42)..(42): The residue at this position is Lys modified with a Y2 group attached to its epsilon amino group

SEQ ID NO: 43 - protein, 39 aa, Artificial Sequence; identical to SEQ ID NO: 6
  Component of peptide hormone analogue
  MOD_RES (2)..(2): Aib
  MOD_RES (39)..(39): The residue at this position is Lys modified with a Y2 group attached to its epsilon amino group

SEQ ID NO: 44 - protein, 39 aa, Artificial Sequence; identical to SEQ ID NO: 6
  Component of peptide hormone analogue
  MOD_RES (2)..(2): Aib
  MOD_RES (39)..(39): The residue at this position is Lys modified with a Y2 group attached to its epsilon amino group

SEQ ID NO: 45 - protein, 39 aa, Artificial Sequence; identical to SEQ ID NO: 6
  Component of peptide hormone analogue
  MOD_RES (2)..(2): Aib
  MOD_RES (39)..(39): The residue at this position is Lys modified with a Y2 group attached to its epsilon amino group

SEQ ID NO: 46 - protein, 39 aa, Artificial Sequence; identical to SEQ ID NO: 19
  Component of peptide hormone analogue
  MOD_RES (2)..(2): Aib
  MOD_RES (39)..(39): The residue at this position is Lys modified with a Y2 group attached to its epsilon amino group

SEQ ID NO: 47 - protein, 39 aa, Artificial Sequence; identical to SEQ ID NO: 19
  Component of peptide hormone analogue
  MOD_RES (2)..(2): Aib
  MOD_RES (39)..(39): The residue at this position is Lys modified with a Y2 group attached to its epsilon amino group

SEQ ID NO: 48 - protein, 39 aa, Artificial Sequence; identical to SEQ ID NO: 19
  Component of peptide hormone analogue
  MOD_RES (2)..(2): Aib
  MOD_RES (39)..(39): The residue at this position is Lys modified with a Y2 group attached to its epsilon amino group

SEQ ID NO: 49 - protein, 39 aa, Artificial Sequence; identical to SEQ ID NO: 19
  Component of peptide hormone analogue
  MOD_RES (2)..(2): Aib
  MOD_RES (39)..(39): The residue at this position is Lys modified with a Y2 group attached to its epsilon amino group

SEQ ID NO: 50 - protein, 39 aa, Artificial Sequence; identical to SEQ ID NO: 19
  Component of peptide hormone analogue
  MOD_RES (2)..(2): Aib
  MOD_RES (39)..(39): The residue at this position is Lys modified with a Y2 group attached to its epsilon amino group

SEQ ID NO: 51 - protein, 41 aa, Artificial Sequence; identical to SEQ ID NO: 11
  Component of peptide hormone analogue
  MOD_RES (2)..(2): Aib
  MOD_RES (41)..(41): The residue at this position is Lys modified with a Y2 group attached to its epsilon amino group

SEQ ID NO: 52 - protein, 41 aa, Artificial Sequence; identical to SEQ ID NO: 11
  Component of peptide hormone analogue
  MOD_RES (2)..(2): Aib
  MOD_RES (41)..(41): The residue at this position is Lys modified with a Y2 group attached to its epsilon amino group

SEQ ID NO: 53 - protein, 39 aa, Artificial Sequence; identical to SEQ ID NO: 19
  Component of peptide hormone analogue
  MOD_RES (2)..(2): Aib
  MOD_RES (39)..(39): The residue at this position is Lys modified with a Y2 group attached to its epsilon amino group

SEQ ID NO: 54 - protein, 39 aa, Artificial Sequence; identical to SEQ ID NO: 19
  Component of peptide hormone analogue
  MOD_RES (2)..(2): Aib
  MOD_RES (39)..(39): The residue at this position is Lys modified with a Y2 group attached to its epsilon amino group

SEQ ID NO: 55 - protein, 39 aa, Artificial Sequence; identical to SEQ ID NO: 19
  Component of peptide hormone analogue
  MOD_RES (2)..(2): Aib
  MOD_RES (39)..(39): The residue at this position is Lys modified with a Y2 group attached to its epsilon amino group

SEQ ID NO: 56 - protein, 39 aa, Artificial Sequence; identical to SEQ ID NO: 19
  Component of peptide hormone analogue
  MOD_RES (2)..(2): Aib
  MOD_RES (39)..(39): The residue at this position is Lys modified with a Y2 group attached to its epsilon amino group

SEQ ID NO: 57 - protein, 39 aa, Artificial Sequence; identical to SEQ ID NO: 19
  Component of peptide hormone analogue
  MOD_RES (2)..(2): Aib
  MOD_RES (39)..(39): The residue at this position is Lys modified with a Y2 group attached to its epsilon amino group

SEQ ID NO: 58 - protein, 39 aa, Artificial Sequence; identical to SEQ ID NO: 19
  Component of peptide hormone analogue
  MOD_RES (2)..(2): Aib
  MOD_RES (39)..(39): The residue at this position is Lys modified with a Y2 group attached to its epsilon amino group

SEQ ID NO: 59 - protein, 39 aa, Artificial Sequence; identical to SEQ ID NO: 19
  Component of peptide hormone analogue
  MOD_RES (2)..(2): Aib
  MOD_RES (39)..(39): The residue at this position is Lys modified with a Y2 group attached to its epsilon amino group

SEQ ID NO: 60 - protein, 39 aa, Artificial Sequence; identical to SEQ ID NO: 19
  Component of peptide hormone analogue
  MOD_RES (2)..(2): Aib
  MOD_RES (39)..(39): The residue at this position is Lys modified with a Y2 group attached to its epsilon amino group

SEQ ID NO: 61 - protein, 39 aa, Artificial Sequence; identical to SEQ ID NO: 19
  Component of peptide hormone analogue
  MOD_RES (2)..(2): Aib
  MOD_RES (39)..(39): The residue at this position is Lys modified with a Y2 group attached to its epsilon amino group

SEQ ID NO: 62 - protein, 39 aa, Artificial Sequence; identical to SEQ ID NO: 19
  Component of peptide hormone analogue
  MOD_RES (2)..(2): Aib
  MOD_RES (39)..(39): The residue at this position is Lys modified with a Y2 group attached to its epsilon amino group

SEQ ID NO: 63 - protein, 39 aa, Artificial Sequence; identical to SEQ ID NO: 19
  Component of peptide hormone analogue
  MOD_RES (2)..(2): Aib
  MOD_RES (39)..(39): The residue at this position is Lys modified with a Y2 group attached to its epsilon amino group

SEQ ID NO: 64 - protein, 39 aa, Artificial Sequence; identical to SEQ ID NO: 19
  Component of peptide hormone analogue
  MOD_RES (2)..(2): Aib
  MOD_RES (39)..(39): The residue at this position is Lys modified with a Y2 group attached to its epsilon amino group

SEQ ID NO: 65 - protein, 39 aa, Artificial Sequence; identical to SEQ ID NO: 19
  Component of peptide hormone analogue
  MOD_RES (2)..(2): Aib
  MOD_RES (39)..(39): The residue at this position is Lys modified with a Y2 group attached to its epsilon amino group

SEQ ID NO: 66 - protein, 39 aa, Artificial Sequence; identical to SEQ ID NO: 19
  Component of peptide hormone analogue
  MOD_RES (2)..(2): Aib
  MOD_RES (39)..(39): The residue at this position is Lys modified with a Y2 group attached to its epsilon amino group

SEQ ID NO: 67 - protein, 39 aa, Artificial Sequence; identical to SEQ ID NO: 19
  Component of peptide hormone analogue
  MOD_RES (2)..(2): Aib
  MOD_RES (39)..(39): The residue at this position is Lys modified with a Y2 group attached to its epsilon amino group

SEQ ID NO: 68 - protein, 38 aa, Artificial Sequence; identical to SEQ ID NO: 10
  Component of peptide hormone analogue
  MOD_RES (2)..(2): Aib
  MOD_RES (38)..(38): The residue at this position is Lys modified with a Y2 group attached to its epsilon amino group

SEQ ID NO: 69 - protein, 39 aa, Artificial Sequence; identical to SEQ ID NO: 9
  Component of peptide hormone analogue
  MOD_RES (2)..(2): Aib
  MOD_RES (39)..(39): The residue at this position is Lys modified with a Y2 group attached to its epsilon amino group

SEQ ID NO: 70 - protein, 39 aa, Artificial Sequence; identical to SEQ ID NO: 6
  Component of peptide hormone analogue
  MOD_RES (2)..(2): Aib
  MOD_RES (39)..(39): The residue at this position is Lys modified with a Y2 group attached to its epsilon amino group

SEQ ID NO: 71 - protein, 39 aa, Artificial Sequence; identical to SEQ ID NO: 6
  Component of peptide hormone analogue
  MOD_RES (2)..(2): Aib
  MOD_RES (39)..(39): The residue at this position is Lys modified with a Y2 group attached to its epsilon amino group

SEQ ID NO: 72 - protein, 44 aa, Artificial Sequence; identical to SEQ ID NO: 1
  Component of peptide hormone analogue
  MOD_RES (2)..(2): Aib
  MOD_RES (42)..(42): The residue at this position is Lys modified with a Y2 group attached to its epsilon amino group

SEQ ID NO: 73 - protein, 44 aa, Artificial Sequence
  Component of peptide hormone analogue
  MOD_RES (2)..(2): Aib
  MOD_RES (42)..(42): The residue at this position is Lys modified with a Y2 group attached to its epsilon amino group
HXHGTFTSDYSRYLDERRAQEFIEWLLASHHHHHPSPPPSGKEY

SEQ ID NO: 74 - protein, 42 aa, Artificial Sequence
  Component of peptide hormone analogue
  MOD_RES (2)..(2): Aib
  MOD_RES (42)..(42): The residue at this position is Lys modified with a Y2 group attached to its epsilon amino group
HXHGTFTSDYSRYLDERRAQEFIEWLLASHHHHHPSPPPSGK

SEQ ID NO: 75 - protein, 39 aa, Artificial Sequence; identical to SEQ ID NO: 6
  Component of peptide hormone analogue
  MOD_RES (2)..(2): Aib
  MOD_RES (39)..(39): The residue at this position is Lys modified with a Y2 group attached to its epsilon amino group

SEQ ID NO: 76 - protein, 39 aa, Artificial Sequence; identical to SEQ ID NO: 6
  Component of peptide hormone analogue
  MOD_RES (2)..(2): Aib
  MOD_RES (39)..(39): The residue at this position is Lys modified with a Y2 group attached to its epsilon amino group

SEQ ID NO: 77 - protein, 38 aa, Artificial Sequence; identical to SEQ ID NO: 31
  Component of peptide hormone analogue
  MOD_RES (2)..(2): Aib
  MOD_RES (38)..(38): The residue at this position is Lys modified with a Y2 group attached to its epsilon amino group

SEQ ID NO: 78 - protein, 38 aa, Artificial Sequence; identical to SEQ ID NO: 31
  Component of peptide hormone analogue
  MOD_RES (2)..(2): Aib
  MOD_RES (38)..(38): The residue at this position is Lys modified with a Y2 group attached to its epsilon amino group

SEQ ID NO: 79 - protein, 41 aa, Artificial Sequence; identical to SEQ ID NO: 11
  Component of peptide hormone analogue
  MOD_RES (2)..(2): Aib
  MOD_RES (41)..(41): The residue at this position is Lys modified with a Y2 group attached to its epsilon amino group

SEQ ID NO: 80 - protein, 41 aa, Artificial Sequence; identical to SEQ ID NO: 11
  Component of peptide hormone analogue
  MOD_RES (2)..(2): Aib
  MOD_RES (41)..(41): The residue at this position is Lys modified with a Y2 group attached to its epsilon amino group

SEQ ID NO: 81 - protein, 39 aa, Artificial Sequence; identical to SEQ ID NO: 33
  Component of peptide hormone analogue
  MOD_RES (2)..(2): Aib
  MOD_RES (39)..(39): The residue at this position is Lys modified with a Y2 group attached to its epsilon amino group

SEQ ID NO: 82 - protein, 39 aa, Artificial Sequence; identical to SEQ ID NO: 33
  Component of peptide hormone analogue
  MOD_RES (2)..(2): Aib
  MOD_RES (39)..(39): The residue at this position is Lys modified with a Y2 group attached to its epsilon amino group

SEQ ID NO: 83 - protein, 39 aa, Artificial Sequence; identical to SEQ ID NO: 33
  Component of peptide hormone analogue
  MOD_RES (2)..(2): Aib
  MOD_RES (39)..(39): The residue at this position is Lys modified with a Y2 group attached to its epsilon amino group

SEQ ID NO: 84 - protein, 39 aa, Artificial Sequence; identical to SEQ ID NO: 33
  Component of peptide hormone analogue
  MOD_RES (2)..(2): Aib
  MOD_RES (39)..(39): The residue at this position is Lys modified with a Y2 group attached to its epsilon amino group

SEQ ID NO: 85 - protein, 38 aa, Artificial Sequence
  Component of peptide hormone analogue
  MOD_RES (2)..(2): Aib
  MOD_RES (38)..(38): The residue at this position is Lys modified with a Y2 group attached to its epsilon amino group
HXHGTFTSDYSRYLDEKRAHEFIEWLLHGHHHHHASGK

SEQ ID NO: 86 - protein, 38 aa, Artificial Sequence; identical to SEQ ID NO: 85
  Component of peptide hormone analogue
  MOD_RES (2)..(2): Aib
  MOD_RES (38)..(38): The residue at this position is Lys modified with a Y2 group attached to its epsilon amino group

SEQ ID NO: 87 - protein, 38 aa, Artificial Sequence; identical to SEQ ID NO: 10
  Component of peptide hormone analogue
  MOD_RES (2)..(2): Aib
  MOD_RES (38)..(38): The residue at this position is Lys modified with a Y2 group attached to its epsilon amino group

SEQ ID NO: 88 - protein, 39 aa, Artificial Sequence; identical to SEQ ID NO: 32
  Component of peptide hormone analogue
  MOD_RES (2)..(2): Aib
  MOD_RES (39)..(39): The residue at this position is Lys modified with a Y2 group attached to its epsilon amino group

SEQ ID NO: 89 - protein, 44 aa, Artificial Sequence; identical to SEQ ID NO: 1
  Component of peptide hormone analogue
  MOD_RES (2)..(2): Aib
  MOD_RES (42)..(42): The residue at this position is Lys modified with a Y2 group attached to its epsilon amino group

SEQ ID NO: 90 - protein, 44 aa, Artificial Sequence; identical to SEQ ID NO: 1
  Component of peptide hormone analogue
  MOD_RES (2)..(2): Aib
  MOD_RES (42)..(42): The residue at this position is Lys modified with a Y2 group attached to its epsilon amino group

SEQ ID NO: 91 - protein, 44 aa, Artificial Sequence; identical to SEQ ID NO: 1
  Component of peptide hormone analogue
  MOD_RES (2)..(2): Aib
  MOD_RES (42)..(42): The residue at this position is Lys modified with a Y2 group attached to its epsilon amino group

SEQ ID NO: 92 - protein, 41 aa, Artificial Sequence; identical to SEQ ID NO: 11
  Component of peptide hormone analogue
  MOD_RES (2)..(2): Aib
  MOD_RES (41)..(41): The residue at this position is Lys modified with a Y2 group attached to its epsilon amino group

SEQ ID NO: 93 - protein, 41 aa, Artificial Sequence; identical to SEQ ID NO: 11
  Component of peptide hormone analogue
  MOD_RES (2)..(2): Aib
  MOD_RES (41)..(41): The residue at this position is Lys modified with a Y2 group attached to its epsilon amino group

SEQ ID NO: 94 - protein, 41 aa, Artificial Sequence; identical to SEQ ID NO: 11
  Component of peptide hormone analogue
  MOD_RES (2)..(2): Aib
  MOD_RES (41)..(41): The residue at this position is Lys modified with a Y2 group attached to its epsilon amino group

SEQ ID NO: 95 - protein, 41 aa, Artificial Sequence; identical to SEQ ID NO: 11
  Component of peptide hormone analogue
  MOD_RES (2)..(2): Aib
  MOD_RES (41)..(41): The residue at this position is Lys modified with a Y2 group attached to its epsilon amino group

SEQ ID NO: 96 - protein, 38 aa, Artificial Sequence; identical to SEQ ID NO: 31
  Component of peptide hormone analogue
  MOD_RES (2)..(2): Aib
  MOD_RES (38)..(38): The residue at this position is Lys modified with a Y2 group attached to its epsilon amino group

SEQ ID NO: 97 - protein, 39 aa, Artificial Sequence; identical to SEQ ID NO: 33
  Component of peptide hormone analogue
  MOD_RES (2)..(2): Aib
  MOD_RES (39)..(39): The residue at this position is Lys modified with a Y2 group attached to its epsilon amino group

SEQ ID NO: 98 - protein, 40 aa, Artificial Sequence
  Component of peptide hormone analogue
  MOD_RES (2)..(2): Aib
  MOD_RES (40)..(40): The residue at this position is Lys modified with a Y2 group attached to its epsilon amino group
HXHGTFTSDYSRYLDERRAQEFIEWLLASHHHHHPSPPPK

SEQ ID NO: 99 - protein, 40 aa, Artificial Sequence; identical to SEQ ID NO: 98
  Component of peptide hormone analogue
  MOD_RES (2)..(2): Aib
  MOD_RES (40)..(40): The residue at this position is Lys modified with a Y2 group attached to its epsilon amino group

SEQ ID NO: 100 - protein, 40 aa, Artificial Sequence; identical to SEQ ID NO: 98
  Component of peptide hormone analogue
  MOD_RES (2)..(2): Aib
  MOD_RES (40)..(40): The residue at this position is Lys modified with a Y2 group attached to its epsilon amino group

SEQ ID NO: 101 - protein, 40 aa, Artificial Sequence; identical to SEQ ID NO: 98
  Component of peptide hormone analogue
  MOD_RES (2)..(2): Aib
  MOD_RES (40)..(40): The residue at this position is Lys modified with a Y2 group attached to its epsilon amino group

SEQ ID NO: 102 - protein, 39 aa, Artificial Sequence
  Component of peptide hormone analogue
  MOD_RES (2)..(2): Aib
  MOD_RES (39)..(39): The residue at this position is Lys modified with a Y2 group attached to its epsilon amino group
HXHGTFTSDYSRYLDERRAQEFIEWLLHGHHHHHSGEGK

SEQ ID NO: 103 - protein, 39 aa, Artificial Sequence; identical to SEQ ID NO: 102
  Component of peptide hormone analogue
  MOD_RES (2)..(2): Aib
  MOD_RES (39)..(39): The residue at this position is Lys modified with a Y2 group attached to its epsilon amino group

SEQ ID NO: 104 - protein, 39 aa, Artificial Sequence; identical to SEQ ID NO: 102
  Component of peptide hormone analogue
  MOD_RES (2)..(2): Aib
  MOD_RES (39)..(39): The residue at this position is Lys modified with a Y2 group attached to its epsilon amino group

SEQ ID NO: 105 - protein, 41 aa, Artificial Sequence
  Component of peptide hormone analogue
  MOD_RES (2)..(2): Aib
  MOD_RES (41)..(41): The residue at this position is Lys modified with a Y2 group attached to its epsilon amino group
HXHGTFTSDYSRYLDQRRAQEFIEWLLASHHHHHPSPPPGK

SEQ ID NO: 106 - protein, 41 aa, Artificial Sequence
  Component of peptide hormone analogue
  MOD_RES (2)..(2): Aib
  MOD_RES (41)..(41): The residue at this position is Lys modified with a Y2 group attached to its epsilon amino group
HXHGTFTSDYSRYLDAKRAQEFIEWLLASHHHHHPSPPPGK

SEQ ID NO: 107 - protein, 41 aa, Artificial Sequence
  Component of peptide hormone analogue
  MOD_RES (2)..(2): Aib
  MOD_RES (41)..(41): The residue at this position is Lys modified with a Y2 group attached to its epsilon amino group
HXHGTFTSDYSRYLDAKRAQEFIEWLLQSHHHHHPSPPPGK

SEQ ID NO: 108 - protein, 44 aa, Artificial Sequence
  Component of peptide hormone analogue
  MOD_RES (2)..(2): Aib
  MOD_RES (42)..(42): The residue at this position is Lys modified with a Y2 group attached to its epsilon amino group
HXHGTFTSDYSKYLDAKRAQEFIEWLLQSHHHHHESPPPSGKSW

SEQ ID NO: 109 - protein, 44 aa, Artificial Sequence; identical to SEQ ID NO: 1
  Component of peptide hormone analogue
  MOD_RES (2)..(2): Aib
  MOD_RES (42)..(42): The residue at this position is Lys modified with a Y2 group attached to its epsilon amino group

SEQ ID NO: 110 - protein, 44 aa, Artificial Sequence; identical to SEQ ID NO: 1
  Component of peptide hormone analogue
  MOD_RES (2)..(2): Aib
  MOD_RES (42)..(42): The residue at this position is Lys modified with a Y2 group attached to its epsilon amino group

SEQ ID NO: 111 - protein, 45 aa, Artificial Sequence
  Component of peptide hormone analogue
  MOD_RES (2)..(2): Aib
  MOD_RES (42)..(42): The residue at this position is Lys modified with a Y2 group attached to its epsilon amino group
HXHGTFTSDYSRYLDERRAQEFIEWLLASHHHHHPSPPPSGKEYE

SEQ ID NO: 112 - protein, 41 aa, Artificial Sequence
  Component of peptide hormone analogue
  MOD_RES (2)..(2): Aib
  MOD_RES (41)..(41): The residue at this position is Lys modified with a Y2 group attached to its epsilon amino group
HXHGTFTSDYSRYLDERRAQEFIEWLLASHHHHHPSPPSGK

SEQ ID NO: 113 - protein, 44 aa, Artificial Sequence
  Component of peptide hormone analogue
  MOD_RES (2)..(2): Aib
  MOD_RES (42)..(42): The residue at this position is Lys modified with a Y2 group attached to its epsilon amino group
HXHGTFTSDYSRYLDERRAQEFIEWLLTGHHHHHPSPPPSGKSW

SEQ ID NO: 114 - protein, 44 aa, Artificial Sequence
  Component of peptide hormone analogue
  MOD_RES (2)..(2): Aib
  MOD_RES (42)..(42): The residue at this position is Lys modified with a Y2 group attached to its epsilon amino group
HXHGTFTSDYSRYLDAKRAQEFIEWLLQSHHHHHPSPPPSGKSW

SEQ ID NO: 115 - protein, 39 aa, Artificial Sequence; identical to SEQ ID NO: 6
  Component of peptide hormone analogue
  MOD_RES (2)..(2): Aib
  MOD_RES (39)..(39): The residue at this position is Lys modified with a Y2 group attached to its epsilon amino group

SEQ ID NO: 116 - protein, 39 aa, Artificial Sequence; identical to SEQ ID NO: 102
  Component of peptide hormone analogue
  MOD_RES (2)..(2): Aib
  MOD_RES (39)..(39): The residue at this position is Lys modified with a Y2 group attached to its epsilon amino group

SEQ ID NO: 117 - protein, 39 aa, Artificial Sequence; identical to SEQ ID NO: 33
  Component of peptide hormone analogue
  MOD_RES (2)..(2): Aib
  MOD_RES (39)..(39): The residue at this position is Lys modified with a Y2 group attached to its epsilon amino group

SEQ ID NO: 118 - protein, 38 aa, Artificial Sequence; identical to SEQ ID NO: 31
  Component of peptide hormone analogue
  MOD_RES (2)..(2): Aib
  MOD_RES (38)..(38): The residue at this position is Lys modified with a Y2 group attached to its epsilon amino group

SEQ ID NO: 119 - protein, 38 aa, Artificial Sequence; identical to SEQ ID NO: 24
  Component of peptide hormone analogue
  MOD_RES (2)..(2): Aib
  MOD_RES (38)..(38): The residue at this position is Lys modified with a Y2 group attached to its epsilon amino group

SEQ ID NO: 120 - protein, 38 aa, Artificial Sequence; identical to SEQ ID NO: 2
  Component of peptide hormone analogue
  MOD_RES (2)..(2): Aib
  MOD_RES (38)..(38): The residue at this position is Lys modified with a Y2 group attached to its epsilon amino group

SEQ ID NO: 121 - protein, 41 aa, Artificial Sequence; identical to SEQ ID NO: 11
  Component of peptide hormone analogue
  MOD_RES (2)..(2): Aib
  MOD_RES (41)..(41): The residue at this position is Lys modified with a Y2 group attached to its epsilon amino group

SEQ ID NO: 122 - protein, 38 aa, Artificial Sequence; identical to SEQ ID NO: 41
  Component of peptide hormone analogue
  MOD_RES (2)..(2): Aib
  MOD_RES (38)..(38): The residue at this position is Lys modified with a Y2 group attached to its epsilon amino group

SEQ ID NO: 123 - protein, 39 aa, Artificial Sequence; identical to SEQ ID NO: 19
  Component of peptide hormone analogue
  MOD_RES (2)..(2): Aib
  MOD_RES (39)..(39): The residue at this position is Lys modified with a Y2 group attached to its epsilon amino group

SEQ ID NO: 124 - protein, 39 aa, Artificial Sequence; identical to SEQ ID NO: 19
  Component of peptide hormone analogue
  MOD_RES (2)..(2): Aib
  MOD_RES (39)..(39): The residue at this position is Lys modified with a Y2 group attached to its epsilon amino group

SEQ ID NO: 125 - protein, 39 aa, Artificial Sequence; identical to SEQ ID NO: 19
  Component of peptide hormone analogue
  MOD_RES (2)..(2): Aib
  MOD_RES (39)..(39): The residue at this position is Lys modified with a Y2 group attached to its epsilon amino group

SEQ ID NO: 126 - protein, 39 aa, Artificial Sequence; identical to SEQ ID NO: 19
  Component of peptide hormone analogue
  MOD_RES (2)..(2): Aib
  MOD_RES (39)..(39): The residue at this position is Lys modified with a Y2 group attached to its epsilon amino group

SEQ ID NO: 127 - protein, 39 aa, Artificial Sequence; identical to SEQ ID NO: 6
  Component of peptide hormone analogue
  MOD_RES (2)..(2): Aib
  MOD_RES (39)..(39): The residue at this position is Lys modified with a Y2 group attached to its epsilon amino group

SEQ ID NO: 128 - protein, 39 aa, Artificial Sequence; identical to SEQ ID NO: 6
  Component of peptide hormone analogue
  MOD_RES (2)..(2): Aib
  MOD_RES (39)..(39): The residue at this position is Lys modified with a Y2 group attached to its epsilon amino group

SEQ ID NO: 129 - protein, 39 aa, Artificial Sequence; identical to SEQ ID NO: 6
  Component of peptide hormone analogue
  MOD_RES (2)..(2): Aib
  MOD_RES (39)..(39): The residue at this position is Lys modified with a Y2 group attached to its epsilon amino group

SEQ ID NO: 130 - protein, 41 aa, Artificial Sequence
  Component of peptide hormone analogue
  MOD_RES (2)..(2): Aib
  MOD_RES (41)..(41): The residue at this position is Lys modified with a Y2 group attached to its epsilon amino group
HXHGTFTSDYSRYLDQRRAQEFIEWLLATHHHHHPSPPPGK

SEQ ID NO: 131 - protein, 41 aa, Artificial Sequence; identical to SEQ ID NO: 130
  Component of peptide hormone analogue
  MOD_RES (2)..(2): Aib
  MOD_RES (41)..(41): The residue at this position is Lys modified with a Y2 group attached to its epsilon amino group

SEQ ID NO: 132 - protein, 41 aa, Artificial Sequence; identical to SEQ ID NO: 130
  Component of peptide hormone analogue
  MOD_RES (2)..(2): Aib
  MOD_RES (41)..(41): The residue at this position is Lys modified with a Y2 group attached to its epsilon amino group

SEQ ID NO: 133 - protein, 41 aa, Artificial Sequence; identical to SEQ ID NO: 130
  Component of peptide hormone analogue
  MOD_RES (2)..(2): Aib
  MOD_RES (41)..(41): The residue at this position is Lys modified with a Y2 group attached to its epsilon amino group

SEQ ID NO: 134 - protein, 41 aa, Artificial Sequence
  Component of peptide hormone analogue
  MOD_RES (2)..(2): Aib
  MOD_RES (41)..(41): The residue at this position is Lys modified with a Y2 group attached to its epsilon amino group
HXHGTFTSDYSRYLDERRAQEFIEWLLTGHHHHHPSPPPGK

SEQ ID NO: 135 - protein, 41 aa, Artificial Sequence; identical to SEQ ID NO: 130
  Component of peptide hormone analogue
  MOD_RES (2)..(2): Aib
  MOD_RES (41)..(41): The residue at this position is Lys modified with a Y2 group attached to its epsilon amino group

SEQ ID NO: 136 - protein, 41 aa, Artificial Sequence
  Component of peptide hormone analogue
  MOD_RES (2)..(2): Aib
  MOD_RES (41)..(41): The residue at this position is Lys modified with a Y2 group attached to its epsilon amino group
HXHGTFTSDYSKYLDAKRAQEFIEWLLQSHHHHHPSPPPGK

SEQ ID NO: 137 - protein, 41 aa, Artificial Sequence; identical to SEQ ID NO: 134
  Component of peptide hormone analogue
  MOD_RES (2)..(2): Aib
  MOD_RES (41)..(41): The residue at this position is Lys modified with a Y2 group attached to its epsilon amino group

SEQ ID NO: 138 - protein, 38 aa, Artificial Sequence; identical to SEQ ID NO: 85
  Component of peptide hormone analogue
  MOD_RES (2)..(2): Aib
  MOD_RES (38)..(38): The residue at this position is Lys modified with a Y2 group attached to its epsilon amino group

SEQ ID NO: 139 - protein, 38 aa, Artificial Sequence; identical to SEQ ID NO: 85
  Component of peptide hormone analogue
  MOD_RES (2)..(2): Aib
  MOD_RES (38)..(38): The residue at this position is Lys modified with a Y2 group attached to its epsilon amino group

SEQ ID NO: 140 - protein, 38 aa, Artificial Sequence; identical to SEQ ID NO: 85
  Component of peptide hormone analogue
  MOD_RES (2)..(2): Aib
  MOD_RES (38)..(38): The residue at this position is Lys modified with a Y2 group attached to its epsilon amino group

SEQ ID NO: 141 - protein, 38 aa, Artificial Sequence; identical to SEQ ID NO: 85
  Component of peptide hormone analogue
  MOD_RES (2)..(2): Aib
  MOD_RES (38)..(38): The residue at this position is Lys modified with a Y2 group attached to its epsilon amino group

SEQ ID NO: 142 - protein, 38 aa, Artificial Sequence; identical to SEQ ID NO: 85
  Component of peptide hormone analogue
  MOD_RES (2)..(2): Aib
  MOD_RES (38)..(38): The residue at this position is Lys modified with a Y2 group attached to its epsilon amino group

SEQ ID NO: 143 - protein, 38 aa, Artificial Sequence; identical to SEQ ID NO: 2
  Component of peptide hormone analogue
  MOD_RES (2)..(2): Aib
  MOD_RES (38)..(38): The residue at this position is Lys modified with a Y2 group attached to its epsilon amino group

SEQ ID NO: 144 - protein, 38 aa, Artificial Sequence; identical to SEQ ID NO: 2
  Component of peptide hormone analogue
  MOD_RES (2)..(2): Aib
  MOD_RES (38)..(38): The residue at this position is Lys modified with a Y2 group attached to its epsilon amino group

SEQ ID NO: 145 - protein, 38 aa, Artificial Sequence; identical to SEQ ID NO: 2
  Component of peptide hormone analogue
  MOD_RES (2)..(2): Aib
  MOD_RES (38)..(38): The residue at this position is Lys modified with a Y2 group attached to its epsilon amino group

SEQ ID NO: 146 - protein, 38 aa, Artificial Sequence; identical to SEQ ID NO: 2
  Component of peptide hormone analogue
  MOD_RES (2)..(2): Aib
  MOD_RES (38)..(38): The residue at this position is Lys modified with a Y2 group attached to its epsilon amino group

SEQ ID NO: 147 - protein, 38 aa, Artificial Sequence; identical to SEQ ID NO: 2
  Component of peptide hormone analogue
  MOD_RES (2)..(2): Aib
  MOD_RES (38)..(38): The residue at this position is Lys modified with a Y2 group attached to its epsilon amino group

SEQ ID NO: 148 - protein, 38 aa, Artificial Sequence; identical to SEQ ID NO: 24
  Component of peptide hormone analogue
  MOD_RES (2)..(2): Aib
  MOD_RES (38)..(38): The residue at this position is Lys modified with a Y2 group attached to its epsilon amino group

SEQ ID NO: 149 - protein, 38 aa, Artificial Sequence; identical to SEQ ID NO: 24
  Component of peptide hormone analogue
  MOD_RES (2)..(2): Aib
  MOD_RES (38)..(38): The residue at this position is Lys modified with a Y2 group attached to its epsilon amino group

SEQ ID NO: 150 - protein, 38 aa, Artificial Sequence; identical to SEQ ID NO: 24
  Component of peptide hormone analogue
  MOD_RES (2)..(2): Aib
  MOD_RES (38)..(38): The residue at this position is Lys modified with a Y2 group attached to its epsilon amino group

SEQ ID NO: 151 - protein, 38 aa, Artificial Sequence; identical to SEQ ID NO: 24
  Component of peptide hormone analogue
  MOD_RES (2)..(2): Aib
  MOD_RES (38)..(38): The residue at this position is Lys modified with a Y2 group attached to its epsilon amino group

SEQ ID NO: 152 - protein, 38 aa, Artificial Sequence; identical to SEQ ID NO: 24
  Component of peptide hormone analogue
  MOD_RES (2)..(2): Aib
  MOD_RES (38)..(38): The residue at this position is Lys modified with a Y2 group attached to its epsilon amino group

SEQ ID NO: 153 - protein, 39 aa, Artificial Sequence; identical to SEQ ID NO: 19
  Component of peptide hormone analogue
  MOD_RES (2)..(2): Aib
  MOD_RES (39)..(39): The residue at this position is Lys modified with a Y2 group attached to its epsilon amino group

SEQ ID NO: 154 - protein, 39 aa, Artificial Sequence
  Component of peptide hormone analogue
  MOD_RES (2)..(2): Aib
  MOD_RES (39)..(39): The residue at this position is Lys modified with a Y2 group attached to its epsilon amino group
HXHGTFTSDYSKYLDSRRAQDFVQWLLNTHHHHHSGEGK

SEQ ID NO: 155 - protein, 39 aa, Artificial Sequence
  Component of peptide hormone analogue
  MOD_RES (2)..(2): Aib
  MOD_RES (39)..(39): The residue at this position is Lys modified with a Y2 group attached to its epsilon amino group
HXHGTFTSDYSRYLDQRRAQEFVQWLLATHHHHHPSEGK

SEQ ID NO: 156 - protein, 38 aa, Artificial Sequence; identical to SEQ ID NO: 24
  Component of peptide hormone analogue
  MOD_RES (2)..(2): Aib
  MOD_RES (38)..(38): The residue at this position is Lys modified with a Y2 group attached to its epsilon amino group

SEQ ID NO: 157 - protein, 41 aa, Artificial Sequence; identical to SEQ ID NO: 107
  Component of peptide hormone analogue
  MOD_RES (2)..(2): Aib
  MOD_RES (41)..(41): The residue at this position is Lys modified with a Y2 group attached to its epsilon amino group

SEQ ID NO: 158 - protein, 41 aa, Artificial Sequence; identical to SEQ ID NO: 107
  Component of peptide hormone analogue
  MOD_RES (2)..(2): Aib
  MOD_RES (41)..(41): The residue at this position is Lys modified with a Y2 group attached to its epsilon amino group

SEQ ID NO: 159 - protein, 41 aa, Artificial Sequence; identical to SEQ ID NO: 107
  Component of peptide hormone analogue
  MOD_RES (2)..(2): Aib
  MOD_RES (41)..(41): The residue at this position is Lys modified with a Y2 group attached to its epsilon amino group

SEQ ID NO: 160 - protein, 41 aa, Artificial Sequence; identical to SEQ ID NO: 107
  Component of peptide hormone analogue
  MOD_RES (2)..(2): Aib
  MOD_RES (41)..(41): The residue at this position is Lys modified with a Y2 group attached to its epsilon amino group

SEQ ID NO: 161 - protein, 41 aa, Artificial Sequence; identical to SEQ ID NO: 107
  Component of peptide hormone analogue
  MOD_RES (2)..(2): Aib
  MOD_RES (41)..(41): The residue at this position is Lys modified with a Y2 group attached to its epsilon amino group

SEQ ID NO: 162 - protein, 41 aa, Artificial Sequence; identical to SEQ ID NO: 107
  Component of peptide hormone analogue
  MOD_RES (2)..(2): Aib
  MOD_RES (41)..(41): The residue at this position is Lys modified with a Y2 group attached to its epsilon amino group

SEQ ID NO: 163 - protein, 41 aa, Artificial Sequence
  Component of peptide hormone analogue
  MOD_RES (2)..(2): Aib
  MOD_RES (41)..(41): The residue at this position is Lys modified with a Y2 group attached to its epsilon amino group
HXHGTFTSDYSKYLDAKRAQEFIEWLLQSHHHHHESPPPGK

SEQ ID NO: 164 - protein, 44 aa, Artificial Sequence; identical to SEQ ID NO: 108
  Component of peptide hormone analogue
  MOD_RES (2)..(2): Aib
  MOD_RES (42)..(42): The residue at this position is Lys modified with a Y2 group attached to its epsilon amino group

SEQ ID NO: 165 - protein, 44 aa, Artificial Sequence; identical to SEQ ID NO: 108
  Component of peptide hormone analogue
  MOD_RES (2)..(2): Aib
  MOD_RES (42)..(42): The residue at this position is Lys modified with a Y2 group attached to its epsilon amino group

SEQ ID NO: 166 - protein, 39 aa, Artificial Sequence
  Component of peptide hormone analogue
  MOD_RES (2)..(2): Aib
  MOD_RES (39)..(39): The residue at this position is Lys modified with a Y2 group attached to its epsilon amino group
HXHGTFTSDYSRYLDQKRAQEFIEWLLATHHHHHSGGGK

SEQ ID NO: 167 - protein, 41 aa, Artificial Sequence; identical to SEQ ID NO: 163
  Component of peptide hormone analogue
  MOD_RES (2)..(2): Aib
  MOD_RES (41)..(41): The residue at this position is Lys modified with a Y2 group attached to its epsilon amino group

SEQ ID NO: 168 - protein, 41 aa, Artificial Sequence; identical to SEQ ID NO: 163
  Component of peptide hormone analogue
  MOD_RES (2)..(2): Aib
  MOD_RES (41)..(41): The residue at this position is Lys modified with a Y2 group attached to its epsilon amino group

SEQ ID NO: 169 - protein, 41 aa, Artificial Sequence; identical to SEQ ID NO: 163
  Component of peptide hormone analogue
  MOD_RES (2)..(2): Aib
  MOD_RES (41)..(41): The residue at this position is Lys modified with a Y2 group attached to its epsilon amino group

SEQ ID NO: 170 - protein, 41 aa, Artificial Sequence
  Component of peptide hormone analogue
  MOD_RES (2)..(2): Aib
  MOD_RES (41)..(41): The residue at this position is Lys modified with a Y2 group attached to its epsilon amino group
HXHGTFTSDYSRYLDERRAQEFIEWLLHGHHHHHPSPPPGK

SEQ ID NO: 171 - protein, 39 aa, Artificial Sequence
  Component of peptide hormone analogue
  MOD_RES (2)..(2): Aib
  MOD_RES (39)..(39): The residue at this position is Lys modified with a Y2 group attached to its epsilon amino group
HXHGTFTSDYSRYLDERRAQEFIEWLLHGHHHHHPSPPK

SEQ ID NO: 172 - protein, 41 aa, Artificial Sequence
  Component of peptide hormone analogue
  MOD_RES (2)..(2): Aib
  MOD_RES (41)..(41): The residue at this position is Lys modified with a Y2 group attached to its epsilon amino group
HXHGTFTSDYSRYLDERRAQEFIEWLLNSHHHHHPSPPPGK

SEQ ID NO: 173 - protein, 39 aa, Artificial Sequence
  Component of peptide hormone analogue
  MOD_RES (2)..(2): Aib
  MOD_RES (39)..(39): The residue at this position is Lys modified with a Y2 group attached to its epsilon amino group
HXHGTFTSDYSRYLDERRAQEFIEWLLNSHHHHHPSPPK

SEQ ID NO: 174 - protein, 41 aa, Artificial Sequence; identical to SEQ ID NO: 130
  Component of peptide hormone analogue
  MOD_RES (2)..(2): Aib
  MOD_RES (41)..(41): The residue at this position is Lys modified with a Y2 group attached to its epsilon amino group

SEQ ID NO: 175 - protein, 39 aa, Artificial Sequence
  Component of peptide hormone analogue
  MOD_RES (2)..(2): Aib
  MOD_RES (39)..(39): The residue at this position is Lys modified with a Y2 group attached to its epsilon amino group
HXHGTFTSDYSRYLDQRRAQEFIEWLLATHHHHHPSPPK

SEQ ID NO: 176 - protein, 41 aa, Artificial Sequence; identical to SEQ ID NO: 136
  Component of peptide hormone analogue
  MOD_RES (2)..(2): Aib
  MOD_RES (41)..(41): The residue at this position is Lys modified with a Y2 group attached to its epsilon amino group

SEQ ID NO: 177 - protein, 41 aa, Artificial Sequence; identical to SEQ ID NO: 107
  Component of peptide hormone analogue
  MOD_RES (2)..(2): Aib
  MOD_RES (41)..(41): The residue at this position is Lys modified with a Y2 group attached to its epsilon amino group

SEQ ID NO: 178 - protein, 39 aa, Artificial Sequence
  Component of peptide hormone analogue
  MOD_RES (2)..(2): Aib
  MOD_RES (39)..(39): The residue at this position is Lys modified with a Y2 group attached to its epsilon amino group
HXHGTFTSDYSRYLDAKRAQEFIEWLLQSHHHHHSGEGK

SEQ ID NO: 179 - protein, 39 aa, Artificial Sequence; identical to SEQ ID NO: 19
  Component of peptide hormone analogue
  MOD_RES (2)..(2): Aib
  MOD_RES (39)..(39): The residue at this position is Lys modified with a Y2 group attached to its epsilon amino group

SEQ ID NO: 180 - protein, 39 aa, Artificial Sequence; identical to SEQ ID NO: 19
  Component of peptide hormone analogue
  MOD_RES (2)..(2): Aib
  MOD_RES (39)..(39): The residue at this position is Lys modified with a Y2 group attached to its epsilon amino group

SEQ ID NO: 181 - protein, 41 aa, Artificial Sequence
  Component of peptide hormone analogue
  MOD_RES (2)..(2): Aib
  MOD_RES (41)..(41): The residue at this position is Lys modified with a Y2 group attached to its epsilon amino group
HXHGTFTSDYSRYLDAKRAQEFIEWLLHGHHHHHPSPPPGK

SEQ ID NO: 182 - protein, 41 aa, Artificial Sequence
  Component of peptide hormone analogue
  MOD_RES (2)..(2): Aib
  MOD_RES (41)..(41): The residue at this position is Lys modified with a Y2 group attached to its epsilon amino group
HXHGTFTSDYSRYLDAKRAQEFIEWLLATHHHHHPSPPPGK

SEQ ID NO: 183 - protein, 41 aa, Artificial Sequence
  Component of peptide hormone analogue
  MOD_RES (2)..(2): Aib
  MOD_RES (41)..(41): The residue at this position is Lys modified with a Y2 group attached to its epsilon amino group
HXHGTFTSDYSRYLDAKRAQEFIEWLLNSHHHHHPSPPPGK

SEQ ID NO: 184 - protein, 41 aa, Artificial Sequence
  Component of peptide hormone analogue
  MOD_RES (2)..(2): Aib
  MOD_RES (41)..(41): The residue at this position is Lys modified with a Y2 group attached to its epsilon amino group
HXHGTFTSDYSRYLDAKRAQEFIEWLLNTHHHHHPSPPPGK

SEQ ID NO: 185 - protein, 41 aa, Artificial Sequence
  Component of peptide hormone analogue
  MOD_RES (2)..(2): Aib
  MOD_RES (41)..(41): The residue at this position is Lys modified with a Y2 group attached to its epsilon amino group
HXHGTFTSDYSRYLDAKRAQEFIEWLLNGHHHHHPSPPPGK

SEQ ID NO: 186 - protein, 41 aa, Artificial Sequence
  Component of peptide hormone analogue
  MOD_RES (2)..(2): Aib
  MOD_RES (41)..(41): The residue at this position is Lys modified with a Y2 group attached to its epsilon amino group
HXHGTFTSDYSRYLDAKRAQEFIEWLLQGHHHHHPSPPPGK

SEQ ID NO: 187 - protein, 41 aa, Artificial Sequence
  Component of peptide hormone analogue
  MOD_RES (2)..(2): Aib
  MOD_RES (41)..(41): The residue at this position is Lys modified with a Y2 group attached to its epsilon amino group
HXHGTFTSDYSRYLDAKKAQEFIEWLLQSHHHHHPSPPPGK

SEQ ID NO: 188 - protein, 41 aa, Artificial Sequence
  Component of peptide hormone analogue
  MOD_RES (2)..(2): Aib
  MOD_RES (41)..(41): The residue at this position is Lys modified with a Y2 group attached to its epsilon amino group
HXHGTFTSDYSRYLDAKRAHEFIEWLLNTHHHHHPSPPPGK

SEQ ID NO: 189 - protein, 41 aa, Artificial Sequence; identical to SEQ ID NO: 107
  Component of peptide hormone analogue
  MOD_RES (2)..(2): Aib
  MOD_RES (41)..(41): The residue at this position is Lys modified with a Y2 group attached to its epsilon amino group

SEQ ID NO: 190 - protein, 41 aa, Artificial Sequence
  Component of peptide hormone analogue
  MOD_RES (2)..(2): Aib
  MOD_RES (41)..(41): The residue at this position is Lys modified with a Y2 group attached to its epsilon amino group
HXHGTFTSDYSRYLDQKRAQEFIEWLLATHHHHHPSPPPGK

SEQ ID NO: 191 - protein, 41 aa, Artificial Sequence
  Component of peptide hormone analogue
  MOD_RES (2)..(2): Aib
  MOD_RES (41)..(41): The residue at this position is Lys modified with a Y2 group attached to its epsilon amino group
HXHGTFTSDYSRYLDERRAQEFIEWLLQSHHHHHPSPPPGK

SEQ ID NO: 192 - protein, 41 aa, Artificial Sequence
  Component of peptide hormone analogue
  MOD_RES (2)..(2): Aib
  MOD_RES (41)..(41): The residue at this position is Lys modified with a Y2 group attached to its epsilon amino group
HXHGTFTSDYSRYLDEKRAQEFIEWLLASHHHHHPSPPPGK

SEQ ID NO: 193 - protein, 41 aa, Artificial Sequence; identical to SEQ ID NO: 11
  Component of peptide hormone analogue
  MOD_RES (2)..(2): Aib
  MOD_RES (41)..(41): The residue at this position is Lys modified with a Y2 group attached to its epsilon amino group

SEQ ID NO: 194 - protein, 41 aa, Artificial Sequence
  Component of peptide hormone analogue
  MOD_RES (2)..(2): Aib
  MOD_RES (41)..(41): The residue at this position is Lys modified with a Y2 group attached to its epsilon amino group
HXHGTFTSDYSKYLDEKRAQEFIEWLLASHHHHHPSPPPGK

SEQ ID NO: 195 - protein, 41 aa, Artificial Sequence; identical to SEQ ID NO: 136
  Component of peptide hormone analogue
  MOD_RES (2)..(2): Aib
  MOD_RES (41)..(41): The residue at this position is Lys modified with a Y2 group attached to its epsilon amino group

SEQ ID NO: 196 - protein, 41 aa, Artificial Sequence; identical to SEQ ID NO: 136
  Component of peptide hormone analogue
  MOD_RES (2)..(2): Aib
  MOD_RES (41)..(41): The residue at this position is Lys modified with a Y2 group attached to its epsilon amino group

SEQ ID NO: 197 - protein, 41 aa, Artificial Sequence; identical to SEQ ID NO: 136
  Component of peptide hormone analogue
  MOD_RES (2)..(2): Aib
  MOD_RES (41)..(41): The residue at this position is Lys modified with a Y2 group attached to its epsilon amino group

SEQ ID NO: 198 - protein, 41 aa, Artificial Sequence; identical to SEQ ID NO: 136
  Component of peptide hormone analogue
  MOD_RES (2)..(2): Aib
  MOD_RES (41)..(41): The residue at this position is Lys modified with a Y2 group attached to its epsilon amino group

SEQ ID NO: 199 - protein, 41 aa, Artificial Sequence; identical to SEQ ID NO: 136
  Component of peptide hormone analogue
  MOD_RES (2)..(2): Aib
  MOD_RES (41)..(41): The residue at this position is Lys modified with a Y2 group attached to its epsilon amino group

SEQ ID NO: 200 - protein, 41 aa, Artificial Sequence; identical to SEQ ID NO: 136
  Component of peptide hormone analogue
  MOD_RES (2)..(2): Aib
  MOD_RES (41)..(41): The residue at this position is Lys modified with a Y2 group attached to its epsilon amino group

SEQ ID NO: 201 - protein, 41 aa, Artificial Sequence; identical to SEQ ID NO: 136
  Component of peptide hormone analogue
  MOD_RES (2)..(2): Aib
  MOD_RES (41)..(41): The residue at this position is Lys modified with a Y2 group attached to its epsilon amino group

SEQ ID NO: 202 - protein, 41 aa, Artificial Sequence; identical to SEQ ID NO: 136
  Component of peptide hormone analogue
  MOD_RES (2)..(2): Aib
  MOD_RES (41)..(41): The residue at this position is Lys modified with a Y2 group attached to its epsilon amino group

SEQ ID NO: 203 - protein, 41 aa, Artificial Sequence; identical to SEQ ID NO: 136
  Component of peptide hormone analogue
  MOD_RES (2)..(2): Aib
  MOD_RES (41)..(41): The residue at this position is Lys modified with a Y2 group attached to its epsilon amino group

SEQ ID NO: 204 - protein, 41 aa, Artificial Sequence; identical to SEQ ID NO: 136
  Component of peptide hormone analogue
  MOD_RES (2)..(2): Aib
  MOD_RES (41)..(41): The residue at this position is Lys modified with a Y2 group attached to its epsilon amino group

SEQ ID NO: 205 - protein, 41 aa, Artificial Sequence; identical to SEQ ID NO: 136
  Component of peptide hormone analogue
  MOD_RES (2)..(2): Aib
  MOD_RES (41)..(41): The residue at this position is Lys modified with a Y2 group attached to its epsilon amino group

SEQ ID NO: 206 - protein, 41 aa, Artificial Sequence
  Component of peptide hormone analogue
  MOD_RES (2)..(2): Aib
  MOD_RES (41)..(41): The residue at this position is Lys modified with a Y2 group attached to its epsilon amino group
HXHGTFTSDYSKYLDAKRAQEFIEWLLASHHHHHPSPPPGK

SEQ ID NO: 207 - protein, 41 aa, Artificial Sequence
  Component of peptide hormone analogue
  MOD_RES (2)..(2): Aib
  MOD_RES (41)..(41): The residue at this position is Lys modified with a Y2 group attached to its epsilon amino group
HXHGTFTSDYSKYLDEKRAHEFIEWLLHGHHHHHESPPPGK

SEQ ID NO: 208 - protein, 38 aa, Artificial Sequence
  Component of peptide hormone analogue
  MOD_RES (2)..(2): Aib
  MOD_RES (38)..(38): The residue at this position is Lys modified with a Y2 group attached to its epsilon amino group
HXHGTFTSDYSRYLDAKRAQEFIEWLLQSHHHHHASGK

SEQ ID NO: 209 - protein, 41 aa, Artificial Sequence
  Component of peptide hormone analogue
  MOD_RES (2)..(2): Aib
  MOD_RES (41)..(41): The residue at this position is Lys modified with a Y2 group attached to its epsilon amino group
HXHGTFTSDYSKYLDAKRAQEFIEWLLHGHHHHHESPPPGK

SEQ ID NO: 210 - protein, 38 aa, Artificial Sequence; identical to SEQ ID NO: 85
  Component of peptide hormone analogue
  MOD_RES (2)..(2): Aib
  MOD_RES (38)..(38): The residue at this position is Lys modified with a Y2 group attached to its epsilon amino group

SEQ ID NO: 211 - protein, 41 aa, Artificial Sequence; identical to SEQ ID NO: 136
  Component of peptide hormone analogue
  MOD_RES (2)..(2): Aib
  MOD_RES (41)..(41): The residue at this position is Lys modified with a Y2 group attached to its epsilon amino group

SEQ ID NO: 212 - protein, 41 aa, Artificial Sequence
  Component of peptide hormone analogue
  MOD_RES (2)..(2): Aib
  MOD_RES (41)..(41): The residue at this position is Lys modified with a Y2 group attached to its epsilon amino group
HXHGTFTSDYSRYLDERRAQEFIEWLLASHHHHHESPPPGK

SEQ ID NO: 213 - protein, 41 aa, Artificial Sequence
  Component of peptide hormone analogue
  MOD_RES (2)..(2): Aib
  MOD_RES (41)..(41): The residue at this position is Lys modified with a Y2 group attached to its epsilon amino group
HXHGTFTSDYSRYLDQRRAQEFIEWLLATHHHHHESPPPGK

SEQ ID NO: 214 - protein, 41 aa, Artificial Sequence
  Component of peptide hormone analogue
  MOD_RES (2)..(2): Aib
  MOD_RES (41)..(41): The residue at this position is Lys modified with a Y2 group attached to its epsilon amino group
HXHGTFTSDYSRYLDQKRAQEFIEWLLATHHHHHESPPPGK

SEQ ID NO: 215 - protein, 41 aa, Artificial Sequence
  Component of peptide hormone analogue
  MOD_RES (2)..(2): Aib
  MOD_RES (41)..(41): The residue at this position is Lys modified with a Y2 group attached to its epsilon amino group
HXHGTFTSDYSRYLDQRRAQEFIEWLLQSHHHHHESPPPGK

SEQ ID NO: 216 - protein, 39 aa, Artificial Sequence
  Component of peptide hormone analogue
  MOD_RES (2)..(2): Aib
  MOD_RES (39)..(39): The residue at this position is Lys modified with a Y2 group attached to its epsilon amino group
HXHGTFTSDYSRYLDAKRAQEFIEWLLATHHHHHSGGGK

SEQ ID NO: 217 - protein, 39 aa, Artificial Sequence; identical to SEQ ID NO: 216
  Component of peptide hormone analogue
  MOD_RES (2)..(2): Aib
  MOD_RES (39)..(39): The residue at this position is Lys modified with a Y2 group attached to its epsilon amino group

SEQ ID NO: 218 - protein, 39 aa, Artificial Sequence; identical to SEQ ID NO: 166
  Component of peptide hormone analogue
  MOD_RES (2)..(2): Aib
  MOD_RES (39)..(39): The residue at this position is Lys modified with a Y2 group attached to its epsilon amino group

SEQ ID NO: 219 - protein, 39 aa, Artificial Sequence
  Component of peptide hormone analogue
  MOD_RES (2)..(2): Aib
  MOD_RES (39)..(39): The residue at this position is Lys modified with a Y2 group attached to its epsilon amino group
HXHGTFTSDYSRYLDQKRAQEFIEWLLTGHHHHHASGSK

SEQ ID NO: 220 - protein, 39 aa, Artificial Sequence; identical to SEQ ID NO: 216
  Component of peptide hormone analogue
  MOD_RES (2)..(2): Aib
  MOD_RES (39)..(39): The residue at this position is Lys modified with a Y2 group attached to its epsilon amino group

SEQ ID NO: 221 - protein, 39 aa, Artificial Sequence
  Component of peptide hormone analogue
  MOD_RES (2)..(2): Aib
  MOD_RES (39)..(39): The residue at this position is Lys modified with a Y2 group attached to its epsilon amino group
HXHGTFTSDYSRYLDAKRAQEFIEWLLATHHHHHSGEGK

SEQ ID NO: 222 - protein, 39 aa, Artificial Sequence; identical to SEQ ID NO: 166
  Component of peptide hormone analogue
  MOD_RES (2)..(2): Aib
  MOD_RES (39)..(39): The residue at this position is Lys modified with a Y2 group attached to its epsilon amino group

SEQ ID NO: 223 - protein, 39 aa, Artificial Sequence; identical to SEQ ID NO: 219
  Component of peptide hormone analogue
  MOD_RES (2)..(2): Aib
  MOD_RES (39)..(39): The residue at this position is Lys modified with a Y2 group attached to its epsilon amino group

SEQ ID NO: 224 - protein, 38 aa, Artificial Sequence
  Component of peptide hormone analogue
  MOD_RES (2)..(2): Aib
  MOD_RES (38)..(38): The residue at this position is Lys modified with a Y2 group attached to its epsilon amino group
HXHGTFTSDYSRYLDAKRAHEFIEWLLHGHHHHHASGK

SEQ ID NO: 225 - protein, 39 aa, Artificial Sequence
  Component of peptide hormone analogue
  MOD_RES (2)..(2): Aib
  MOD_RES (39)..(39): The residue at this position is Lys modified with a Y2 group attached to its epsilon amino group
HXHGTFTSDYSRYLDQKRAHEFIEWLLHGHHHHHASGGK

SEQ ID NO: 226 - protein, 39 aa, Artificial Sequence
  Component of peptide hormone analogue
  MOD_RES (2)..(2): Aib
  MOD_RES (39)..(39): The residue at this position is Lys modified with a Y2 group attached to its epsilon amino group
HXHGTFTSDYSRYLDAKRAHEFIEWLLHGHHHHHASGGK

SEQ ID NO: 227 - protein, 38 aa, Artificial Sequence
  Component of peptide hormone analogue
  MOD_RES (2)..(2): Aib
  MOD_RES (38)..(38): The residue at this position is Lys modified with a Y2 group attached to its epsilon amino group
HXHGTFTSDYSKYLDEKRAHEFIEWLLHGHHHHHASGK

SEQ ID NO: 228 - protein, 38 aa, Artificial Sequence
  Component of peptide hormone analogue
  MOD_RES (2)..(2): Aib
  MOD_RES (38)..(38): The residue at this position is Lys modified with a Y2 group attached to its epsilon amino group
HXHGTFTSDYSKYLDAKRAHEFIEWLLHGHHHHHASGK

SEQ ID NO: 229 - protein, 38 aa, Artificial Sequence; identical to SEQ ID NO: 85
  Component of peptide hormone analogue
  MOD_RES (2)..(2): Aib
  MOD_RES (38)..(38): The residue at this position is Lys modified with a Y2 group attached to its epsilon amino group

SEQ ID NO: 230 - protein, 38 aa, Artificial Sequence; identical to SEQ ID NO: 224
  Component of peptide hormone analogue
  MOD_RES (2)..(2): Aib
  MOD_RES (38)..(38): The residue at this position is Lys modified with a Y2 group attached to its epsilon amino group

SEQ ID NO: 231 - protein, 38 aa, Artificial Sequence; identical to SEQ ID NO: 224
  Component of peptide hormone analogue
  MOD_RES (2)..(2): Aib
  MOD_RES (38)..(38): The residue at this position is Lys modified with a Y2 group attached to its epsilon amino group

SEQ ID NO: 232 - protein, 39 aa, Artificial Sequence
  Component of peptide hormone analogue
  MOD_RES (2)..(2): Aib
  MOD_RES (39)..(39): The residue at this position is Lys modified with a Y2 group attached to its epsilon amino group
HXHGTFTSDYSRYLDEKRAQEFIEWLLTGHHHHHASGSK

SEQ ID NO: 233 - protein, 39 aa, Artificial Sequence
  Component of peptide hormone analogue
  MOD_RES (2)..(2): Aib
  MOD_RES (39)..(39): The residue at this position is Lys modified with a Y2 group attached to its epsilon amino group
HXHGTFTSDYSRYLDAKRAQEFIEWLLTGHHHHHASGSK

SEQ ID NO: 234 - protein, 39 aa, Artificial Sequence; identical to SEQ ID NO: 233
  Component of peptide hormone analogue
  MOD_RES (2)..(2): Aib
  MOD_RES (39)..(39): The residue at this position is Lys modified with a Y2 group attached to its epsilon amino group

SEQ ID NO: 235 - protein, 42 aa, Artificial Sequence
  Component of peptide hormone analogue
  MOD_RES (2)..(2): Aib
  MOD_RES (42)..(42): The residue at this position is Lys modified with a Y2 group attached to its epsilon amino group
HXHGTFTSDYSRYLDAKRAQEFIEWLLASHHHHHPSPPPSGK

SEQ ID NO: 236 - protein, 42 aa, Artificial Sequence; identical to SEQ ID NO: 74
  Component of peptide hormone analogue
  MOD_RES (2)..(2): Aib
  MOD_RES (42)..(42): The residue at this position is Lys modified with a Y2 group attached to its epsilon amino group

SEQ ID NO: 237 - protein, 42 aa, Artificial Sequence; identical to SEQ ID NO: 235
  Component of peptide hormone analogue
  MOD_RES (2)..(2): Aib
  MOD_RES (42)..(42): The residue at this position is Lys modified with a Y2 group attached to its epsilon amino group

SEQ ID NO: 238 - protein, 42 aa, Artificial Sequence; identical to SEQ ID NO: 74
  Component of peptide hormone analogue
  MOD_RES (2)..(2): Aib
  MOD_RES (42)..(42): The residue at this position is Lys modified with a Y2 group attached to its epsilon amino group

SEQ ID NO: 239 - protein, 42 aa, Artificial Sequence
  Component of peptide hormone analogue
  MOD_RES (2)..(2): Aib
  MOD_RES (42)..(42): The residue at this position is Lys modified with a Y2 group attached to its epsilon amino group
HXHGTFTSDYSRYLDERRAHEFIEWLLHGHHHHHPSPPPSGK

SEQ ID NO: 240 - protein, 42 aa, Artificial Sequence
  Component of peptide hormone analogue
  MOD_RES (2)..(2): Aib
  MOD_RES (42)..(42): The residue at this position is Lys modified with a Y2 group attached to its epsilon amino group
HXHGTFTSDYSRYLDAKRAHEFIEWLLHGHHHHHPSPPPSGK

SEQ ID NO: 241 - protein, 42 aa, Artificial Sequence; identical to SEQ ID NO: 240
  Component of peptide hormone analogue
  MOD_RES (2)..(2): Aib
  MOD_RES (42)..(42): The residue at this position is Lys modified with a Y2 group attached to its epsilon amino group

SEQ ID NO: 242 - protein, 41 aa, Artificial Sequence
  Component of peptide hormone analogue
  MOD_RES (2)..(2): Aib
  MOD_RES (41)..(41): The residue at this position is Lys modified with a Y2 group attached to its epsilon amino group
HXHGTFTSDYSRYLDAKRAHEFIEWLLHGHHHHHPSPPPGK

SEQ ID NO: 243 - protein, 42 aa, Artificial Sequence
  Component of peptide hormone analogue
  MOD_RES (2)..(2): Aib
  MOD_RES (42)..(42): The residue at this position is Lys modified with a Y2 group attached to its epsilon amino group
HXHGTFTSDYSRYLDAKRAHEFIEWLLHGHHHHHESPPPSGK

SEQ ID NO: 244 - protein, 39 aa, Artificial Sequence; identical to SEQ ID NO: 173
  Component of peptide hormone analogue
  MOD_RES (2)..(2): Aib
  MOD_RES (39)..(39): The residue at this position is Lys modified with a Y2 group attached to its epsilon amino group

SEQ ID NO: 245 - protein, 39 aa, Artificial Sequence
  Component of peptide hormone analogue
  MOD_RES (2)..(2): Aib
  MOD_RES (39)..(39): The residue at this position is Lys modified with a Y2 group attached to its epsilon amino group
HXHGTFTSDYSRYLDAKRAQEFIEWLLNSHHHHHPSPPK

SEQ ID NO: 246 - protein, 39 aa, Artificial Sequence; identical to SEQ ID NO: 19
  Component of peptide hormone analogue
  MOD_RES (2)..(2): Aib
  MOD_RES (39)..(39): The residue at this position is Lys modified with a Y2 group attached to its epsilon amino group

SEQ ID NO: 247 - protein, 42 aa, Artificial Sequence; identical to SEQ ID NO: 74
  Component of peptide hormone analogue
  MOD_RES (2)..(2): Aib
  MOD_RES (42)..(42): The residue at this position is Lys modified with a Y2 group attached to its epsilon amino group

SEQ ID NO: 248 - protein, 41 aa, Artificial Sequence
  Component of peptide hormone analogue
  MOD_RES (2)..(2): Aib
  MOD_RES (41)..(41): The residue at this position is Lys modified with a Y2 group attached to its epsilon amino group
HXHGTFTSDYSRYLDAKRAQEFIEWLLATHHHHHESPPPGK

SEQ ID NO: 249 - protein, 39 aa, Artificial Sequence
  Component of peptide hormone analogue
  MOD_RES (2)..(2): Aib
  MOD_RES (39)..(39): The residue at this position is Lys modified with a Y2 group attached to its epsilon amino group
HXHGTFTSDYSKYLDAKRAQEFIEWLLQSHHHHHPGEGK

SEQ ID NO: 250 - protein, 39 aa, Artificial Sequence
  Component of peptide hormone analogue
  MOD_RES (2)..(2): Aib
  MOD_RES (39)..(39): The residue at this position is Lys modified with a Y2 group attached to its epsilon amino group
HXHGTFTSDYSKYLDAKRAQEFIEWLLQSHHHHHEGEGK

SEQ ID NO: 251 - protein, 39 aa, Artificial Sequence
  Component of peptide hormone analogue
  MOD_RES (2)..(2): Aib
  MOD_RES (39)..(39): The residue at this position is Lys modified with a Y2 group attached to its epsilon amino group
HXHGTFTSDYSKYLDAKRAHEFIEWLLHGHHHHHSGEGK

SEQ ID NO: 252 - protein, 39 aa, Artificial Sequence
  Component of peptide hormone analogue
  MOD_RES (2)..(2): Aib
  MOD_RES (39)..(39): The residue at this position is Lys modified with a Y2 group attached to its epsilon amino group
HXHGTFTSDYSRYLDQKRAQEFIEWLLQSHHHHHSGEGK

SEQ ID NO: 253 - protein, 39 aa, Artificial Sequence
  Component of peptide hormone analogue
  MOD_RES (2)..(2): Aib
  MOD_RES (39)..(39): The residue at this position is Lys modified with a Y2 group attached to its epsilon amino group
HXHGTFTSDYSKYLDAKRAQEFIEWLLNSHHHHHSGEGK

SEQ ID NO: 254 - protein, 39 aa, Artificial Sequence
  Component of peptide hormone analogue
  MOD_RES (2)..(2): Aib
  MOD_RES (39)..(39): The residue at this position is Lys modified with a Y2 group attached to its epsilon amino group
HXHGTFTSDYSKYLDAKRAQEFIEWLLATHHHHHSGEGK

SEQ ID NO: 255 - protein, 41 aa, Artificial Sequence; identical to SEQ ID NO: 163
  Component of peptide hormone analogue
  MOD_RES (2)..(2): Aib
  MOD_RES (41)..(41): The residue at this position is Lys modified with a Y2 group attached to its epsilon amino group

SEQ ID NO: 256 - protein, 41 aa, Artificial Sequence; identical to SEQ ID NO: 163
  Component of peptide hormone analogue
  MOD_RES (2)..(2): Aib
  MOD_RES (41)..(41): The residue at this position is Lys modified with a Y2 group attached to its epsilon amino group

SEQ ID NO: 257 - protein, 41 aa, Artificial Sequence; identical to SEQ ID NO: 107
  Component of peptide hormone analogue
  MOD_RES (2)..(2): Aib
  MOD_RES (41)..(41): The residue at this position is Lys modified with a Y2 group attached to its epsilon amino group

SEQ ID NO: 258 - protein, 41 aa, Artificial Sequence; identical to SEQ ID NO: 130
  Component of peptide hormone analogue
  MOD_RES (2)..(2): Aib
  MOD_RES (41)..(41): The residue at this position is Lys modified with a Y2 group attached to its epsilon amino group

SEQ ID NO: 259 - protein, 39 aa, Artificial Sequence; identical to SEQ ID NO: 173
  Component of peptide hormone analogue
  MOD_RES (2)..(2): Aib
  MOD_RES (39)..(39): The residue at this position is Lys modified with a Y2 group attached to its epsilon amino group

SEQ ID NO: 260 - protein, 41 aa, Artificial Sequence; identical to SEQ ID NO: 163
  Component of peptide hormone analogue
  MOD_RES (2)..(2): Aib
  MOD_RES (41)..(41): The residue at this position is Lys modified with a Y2 group attached to its epsilon amino group

SEQ ID NO: 261 - protein, 41 aa, Artificial Sequence; identical to SEQ ID NO: 163
  Component of peptide hormone analogue
  MOD_RES (2)..(2): Aib
  MOD_RES (41)..(41): The residue at this position is Lys modified with a Y2 group attached to its epsilon amino group

SEQ ID NO: 262 - protein, 41 aa, Artificial Sequence
  Component of peptide hormone analogue
  MOD_RES (2)..(2): Aib
  MOD_RES (41)..(41): The residue at this position is Lys modified with a Y2 group attached to its epsilon amino group
HXHGTFTSDYSKYLDAKRAQEFIEWLLQSHHQHHPSPPPGK

SEQ ID NO: 263 - protein, 41 aa, Artificial Sequence; identical to SEQ ID NO: 262
  Component of peptide hormone analogue
  MOD_RES (2)..(2): Aib
  MOD_RES (41)..(41): The residue at this position is Lys modified with a Y2 group attached to its epsilon amino group

SEQ ID NO: 264 - protein, 41 aa, Artificial Sequence; identical to SEQ ID NO: 136
  Component of peptide hormone analogue
  MOD_RES (2)..(2): Aib
  MOD_RES (41)..(41): The residue at this position is Lys modified with a Y2 group attached to its epsilon amino group

SEQ ID NO: 265 - protein, 41 aa, Artificial Sequence; identical to SEQ ID NO: 136
  Component of peptide hormone analogue
  MOD_RES (2)..(2): Aib
  MOD_RES (41)..(41): The residue at this position is Lys modified with a Y2 group attached to its epsilon amino group

SEQ ID NO: 266 - protein, 40 aa, Artificial Sequence
  Component of peptide hormone analogue
  MOD_RES (2)..(2): Aib
  MOD_RES (40)..(40): The residue at this position is Lys modified with a Y2 group attached to its epsilon amino group
HXHGTFTSDYSKYLDAKRAQEFIEWLLQSHHHHHPSPPPK

SEQ ID NO: 267 - protein, 39 aa, Artificial Sequence
  Component of peptide hormone analogue
  MOD_RES (2)..(2): Aib
  MOD_RES (39)..(39): The residue at this position is Lys modified with a Y2 group attached to its epsilon amino group
HXHGTFTSDYSKYLDAKRAQEFIEWLLQSHHHHHPSPPK

SEQ ID NO: 268 - protein, 40 aa, Artificial Sequence
  Component of peptide hormone analogue
  MOD_RES (2)..(2): Aib
  MOD_RES (40)..(40): The residue at this position is Lys modified with a Y2 group attached to its epsilon amino group
HXHGTFTSDYSKYLDAKRAQEFIEWLLQSHHHHHPSPPGK

SEQ ID NO: 269 - protein, 41 aa, Artificial Sequence; identical to SEQ ID NO: 136
  Component of peptide hormone analogue
  MOD_RES (2)..(2): Aib
  MOD_RES (41)..(41): The residue at this position is Lys modified with a Y2 group attached to its epsilon amino group

SEQ ID NO: 270 - protein, 41 aa, Artificial Sequence; identical to SEQ ID NO: 136
  Component of peptide hormone analogue
  MOD_RES (2)..(2): Aib
  MOD_RES (41)..(41): The residue at this position is Lys modified with a Y2 group attached to its epsilon amino group

SEQ ID NO: 271 - protein, 41 aa, Artificial Sequence; identical to SEQ ID NO: 136
  Component of peptide hormone analogue
  MOD_RES (2)..(2): Aib
  MOD_RES (41)..(41): The residue at this position is Lys modified with a Y2 group attached to its epsilon amino group

SEQ ID NO: 272 - protein, 41 aa, Artificial Sequence; identical to SEQ ID NO: 136
  Component of peptide hormone analogue
  MOD_RES (2)..(2): Aib
  MOD_RES (41)..(41): The residue at this position is Lys modified with a Y2 group attached to its epsilon amino group

SEQ ID NO: 273 - protein, 41 aa, Artificial Sequence; identical to SEQ ID NO: 163
  Component of peptide hormone analogue
  MOD_RES (2)..(2): Aib
  MOD_RES (41)..(41): The residue at this position is Lys modified with a Y2 group attached to its epsilon amino group

SEQ ID NO: 274 - protein, 41 aa, Artificial Sequence; identical to SEQ ID NO: 134
  Component of peptide hormone analogue
  MOD_RES (2)..(2): Aib
  MOD_RES (41)..(41): The residue at this position is Lys modified with a Y2 group attached to its epsilon amino group

SEQ ID NO: 275 - protein, 41 aa, Artificial Sequence
  Component of peptide hormone analogue
  MOD_RES (2)..(2): Aib
  MOD_RES (41)..(41): The residue at this position is Lys modified with a Y2 group attached to its epsilon amino group
HXHGTFTSDYSRYLDAKRAQEFIEWLLQSHHHHHESPPPGK

SEQ ID NO: 276 - protein, 41 aa, Artificial Sequence; identical to SEQ ID NO: 163
  Component of peptide hormone analogue
  MOD_RES (2)..(2): Aib
  MOD_RES (41)..(41): The residue at this position is Lys modified with a Y2 group attached to its epsilon amino group

SEQ ID NO: 277 - protein, 41 aa, Artificial Sequence; identical to SEQ ID NO: 262
  Component of peptide hormone analogue
  MOD_RES (2)..(2): Aib
  MOD_RES (41)..(41): The residue at this position is Lys modified with a Y2 group attached to its epsilon amino group

SEQ ID NO: 278 - protein, 41 aa, Artificial Sequence; identical to SEQ ID NO: 136
  Component of peptide hormone analogue
  MOD_RES (2)..(2): Aib
  MOD_RES (41)..(41): The residue at this position is Lys modified with a Y2 group attached to its epsilon amino group

SEQ ID NO: 279 - protein, 41 aa, Artificial Sequence; identical to SEQ ID NO: 107
  Component of peptide hormone analogue
  MOD_RES (2)..(2): Aib
  MOD_RES (41)..(41): The residue at this position is Lys modified with a Y2 group attached to its epsilon amino group

SEQ ID NO: 280 - protein, 40 aa, Artificial Sequence
  Component of peptide hormone analogue
  MOD_RES (2)..(2): Aib
  MOD_RES (40)..(40): The residue at this position is Lys modified with a Y2 group attached to its epsilon amino group
HXHGTFTSDYSRYLDAKRAQEFIEWLLQSHHHHHESPPGK

SEQ ID NO: 281 - protein, 41 aa, Artificial Sequence; identical to SEQ ID NO: 107
  Component of peptide hormone analogue
  MOD_RES (2)..(2): Aib
  MOD_RES (41)..(41): The residue at this position is Lys modified with a Y2 group attached to its epsilon amino group

SEQ ID NO: 282 - protein, 41 aa, Artificial Sequence
  Component of peptide hormone analogue
  MOD_RES (2)..(2): Aib
  MOD_RES (41)..(41): The residue at this position is Lys modified with a Y2 group attached to its epsilon amino group
HXHGTFTSDYSRYLDARRAQEFIEWLLQSHHHHHPSPPPGK

SEQ ID NO: 283 - protein, 41 aa, Artificial Sequence
  Component of peptide hormone analogue
  MOD_RES (2)..(2): Aib
  MOD_RES (41)..(41): The residue at this position is Lys modified with a Y2 group attached to its epsilon amino group
HXHGTFTSDYSRYLDARRAQEFIEWLLQSHHQHHPSPPPGK

SEQ ID NO: 284 - protein, 41 aa, Artificial Sequence; identical to SEQ ID NO: 282
  Component of peptide hormone analogue
  MOD_RES (2)..(2): Aib
  MOD_RES (41)..(41): The residue at this position is Lys modified with a Y2 group attached to its epsilon amino group

SEQ ID NO: 285 - protein, 41 aa, Artificial Sequence; identical to SEQ ID NO: 282
  Component of peptide hormone analogue
  MOD_RES (2)..(2): Aib
  MOD_RES (41)..(41): The residue at this position is Lys modified with a Y2 group attached to its epsilon amino group

SEQ ID NO: 286 - protein, 41 aa, Artificial Sequence; identical to SEQ ID NO: 282
  Component of peptide hormone analogue
  MOD_RES (2)..(2): Aib
  MOD_RES (41)..(41): The residue at this position is Lys modified with a Y2 group attached to its epsilon amino group

SEQ ID NO: 287 - protein, 41 aa, Artificial Sequence; identical to SEQ ID NO: 282
  Component of peptide hormone analogue
  MOD_RES (2)..(2): Aib
  MOD_RES (41)..(41): The residue at this position is Lys modified with a Y2 group attached to its epsilon amino group

SEQ ID NO: 288 - protein, 41 aa, Artificial Sequence; identical to SEQ ID NO: 282
  Component of peptide hormone analogue
  MOD_RES (2)..(2): Aib
  MOD_RES (41)..(41): The residue at this position is Lys modified with a Y2 group attached to its epsilon amino group

SEQ ID NO: 289 - protein, 41 aa, Artificial Sequence; identical to SEQ ID NO: 136
  Component of peptide hormone analogue
  MOD_RES (2)..(2): Aib
  MOD_RES (41)..(41): The residue at this position is Lys modified with a Y2 group attached to its epsilon amino group

SEQ ID NO: 290 - protein, 41 aa, Artificial Sequence; identical to SEQ ID NO: 136
  Component of peptide hormone analogue
  MOD_RES (2)..(2): Aib
  MOD_RES (41)..(41): The residue at this position is Lys modified with a Y2 group attached to its epsilon amino group

SEQ ID NO: 291 - protein, 41 aa, Artificial Sequence; identical to SEQ ID NO: 282
  Component of peptide hormone analogue
  MOD_RES (2)..(2): Aib
  MOD_RES (41)..(41): The residue at this position is Lys modified with a Y2 group attached to its epsilon amino group

SEQ ID NO: 292 - protein, 41 aa, Artificial Sequence; identical to SEQ ID NO: 282
  Component of peptide hormone analogue
  MOD_RES (2)..(2): Aib
  MOD_RES (41)..(41): The residue at this position is Lys modified with a Y2 group attached to its epsilon amino group

SEQ ID NO: 293 - protein, 41 aa, Artificial Sequence; identical to SEQ ID NO: 107
  Component of peptide hormone analogue
  MOD_RES (2)..(2): Aib
  MOD_RES (41)..(41): The residue at this position is Lys modified with a Y2 group attached to its epsilon amino group

SEQ ID NO: 294 - protein, 41 aa, Artificial Sequence
  Component of peptide hormone analogue
  MOD_RES (2)..(2): Aib
  MOD_RES (41)..(41): The residue at this position is Lys modified with a Y2 group attached to its epsilon amino group
HXHGTFTSDYSRYLDARRAQEFIEWLLNGHHHHHPSPPPGK

SEQ ID NO: 295 - protein, 41 aa, Artificial Sequence; identical to SEQ ID NO: 294
  Component of peptide hormone analogue
  MOD_RES (2)..(2): Aib
  MOD_RES (41)..(41): The residue at this position is Lys modified with a Y2 group attached to its epsilon amino group

SEQ ID NO: 296 - protein, 41 aa, Artificial Sequence; identical to SEQ ID NO: 185
  Component of peptide hormone analogue
  MOD_RES (2)..(2): Aib
  MOD_RES (41)..(41): The residue at this position is Lys modified with a Y2 group attached to its epsilon amino group

SEQ ID NO: 297 - protein, 41 aa, Artificial Sequence
  Component of peptide hormone analogue
  MOD_RES (2)..(2): Aib
  MOD_RES (41)..(41): The residue at this position is Lys modified with a Y2 group attached to its epsilon amino group
HXHGTFTSDYSKYLDERRAHEFIEWLLHGHHHHHESPPPGK

SEQ ID NO: 298 - protein, 41 aa, Artificial Sequence; identical to SEQ ID NO: 297
  Component of peptide hormone analogue
  MOD_RES (2)..(2): Aib
  MOD_RES (41)..(41): The residue at this position is Lys modified with a Y2 group attached to its epsilon amino group

SEQ ID NO: 299 - protein, 41 aa, Artificial Sequence; identical to SEQ ID NO: 207
  Component of peptide hormone analogue
  MOD_RES (2)..(2): Aib
  MOD_RES (41)..(41): The residue at this position is Lys modified with a Y2 group attached to its epsilon amino group

SEQ ID NO: 300 - protein, 41 aa, Artificial Sequence; identical to SEQ ID NO: 282
  Component of peptide hormone analogue
  MOD_RES (2)..(2): Aib
  MOD_RES (41)..(41): The residue at this position is Lys modified with a Y2 group attached to its epsilon amino group

SEQ ID NO: 301 - protein, 41 aa, Artificial Sequence; identical to SEQ ID NO: 136
  Component of peptide hormone analogue
  MOD_RES (2)..(2): Aib
  MOD_RES (41)..(41): The residue at this position is Lys modified with a Y2 group attached to its epsilon amino group

SEQ ID NO: 302 - protein, 41 aa, Artificial Sequence; identical to SEQ ID NO: 107
  Component of peptide hormone analogue
  MOD_RES (2)..(2): Aib
  MOD_RES (41)..(41): The residue at this position is Lys modified with a Y2 group attached to its epsilon amino group

SEQ ID NO: 303 - protein, 41 aa, Artificial Sequence
  Component of peptide hormone analogue
  MOD_RES (2)..(2): Aib
  MOD_RES (41)..(41): The residue at this position is Lys modified with a Y2 group attached to its epsilon amino group
HXHGTFTSDYSRYLDARRAQEFIEWLLASHHHHHESPPPGK

SEQ ID NO: 304 - protein, 41 aa, Artificial Sequence
  Component of peptide hormone analogue
  MOD_RES (2)..(2): Aib
  MOD_RES (41)..(41): The residue at this position is Lys modified with a Y2 group attached to its epsilon amino group
HXHGTFTSDYSRYLDARRAQEFIEWLLHGHHHHHESPPPGK

SEQ ID NO: 305 - protein, 41 aa, Artificial Sequence; identical to SEQ ID NO: 283
  Component of peptide hormone analogue
  MOD_RES (2)..(2): Aib
  MOD_RES (41)..(41): The residue at this position is Lys modified with a Y2 group attached to its epsilon amino group

SEQ ID NO: 306 - protein, 41 aa, Artificial Sequence; identical to SEQ ID NO: 136
  Component of peptide hormone analogue
  MOD_RES (2)..(2): Aib
  MOD_RES (41)..(41): The residue at this position is Lys modified with a Y2 group attached to its epsilon amino group

SEQ ID NO: 307 - protein, 41 aa, Artificial Sequence; identical to SEQ ID NO: 107
  Component of peptide hormone analogue
  MOD_RES (2)..(2): Aib
  MOD_RES (41)..(41): The residue at this position is Lys modified with a Y2 group attached to its epsilon amino group

SEQ ID NO: 308 - protein, 41 aa, Artificial Sequence; identical to SEQ ID NO: 136
  Component of peptide hormone analogue
  MOD_RES (2)..(2): Aib
  MOD_RES (41)..(41): The residue at this position is Lys modified with a Y2 group attached to its epsilon amino group

SEQ ID NO: 309 - protein, 41 aa, Artificial Sequence
  Component of peptide hormone analogue
  MOD_RES (2)..(2): Aib
  MOD_RES (41)..(41): The residue at this position is Lys modified with a Y2 group attached to its epsilon amino group
HXHGTFTSDYSRYLDQRRAQEFIEWLLATHHQHHESPPPGK

SEQ ID NO: 310 - protein, 41 aa, Artificial Sequence
  Component of peptide hormone analogue
  MOD_RES (2)..(2): Aib
  MOD_RES (41)..(41): The residue at this position is Lys modified with a Y2 group attached to its epsilon amino group
HXHGTFTSDYSRYLDQKRAQEFIEWLLATHHQHHESPPPGK

SEQ ID NO: 311 - protein, 40 aa, Artificial Sequence
  Component of peptide hormone analogue
  MOD_RES (2)..(2): Aib
  MOD_RES (40)..(40): The residue at this position is Lys modified with a Y2 group attached to its epsilon amino group
HXHGTFTSDYSRYLDQKRAQEFIEWLLATHHHHHESPPPK

SEQ ID NO: 312 - protein, 41 aa, Artificial Sequence; identical to SEQ ID NO: 214
  Component of peptide hormone analogue
  MOD_RES (2)..(2): Aib
  MOD_RES (41)..(41): The residue at this position is Lys modified with a Y2 group attached to its epsilon amino group

SEQ ID NO: 313 - protein, 40 aa, Artificial Sequence; identical to SEQ ID NO: 311
  Component of peptide hormone analogue
  MOD_RES (2)..(2): Aib
  MOD_RES (40)..(40): The residue at this position is Lys modified with a Y2 group attached to its epsilon amino group

SEQ ID NO: 314 - protein, 41 aa, Artificial Sequence; identical to SEQ ID NO: 136
  Component of peptide hormone analogue
  MOD_RES (2)..(2): Aib
  MOD_RES (41)..(41): The residue at this position is Lys modified with a Y2 group attached to its epsilon amino group

SEQ ID NO: 315 - protein, 40 aa, Artificial Sequence; identical to SEQ ID NO: 266
  Component of peptide hormone analogue
  MOD_RES (2)..(2): Aib
  MOD_RES (40)..(40): The residue at this position is Lys modified with a Y2 group attached to its epsilon amino group

SEQ ID NO: 316 - protein, 41 aa, Artificial Sequence; identical to SEQ ID NO: 136
  Component of peptide hormone analogue
  MOD_RES (2)..(2): Aib
  MOD_RES (41)..(41): The residue at this position is Lys modified with a Y2 group attached to its epsilon amino group

SEQ ID NO: 317 - protein, 40 aa, Artificial Sequence
  Component of peptide hormone analogue
  MOD_RES (2)..(2): Aib
  MOD_RES (40)..(40): The residue at this position is Lys modified with a Y2 group attached to its epsilon amino group
HXHGTFTSDYSKYLDAKRAQEFIEWLLQSHHQHHPSPPPK

SEQ ID NO: 318 - protein, 40 aa, Artificial Sequence
  Component of peptide hormone analogue
  MOD_RES (2)..(2): Aib
  MOD_RES (40)..(40): The residue at this position is Lys modified with a Y2 group attached to its epsilon amino group
HXHGTFTSDYSRYLDARRAQEFIEWLLQSHHQHHPSPPPK

SEQ ID NO: 319 - protein, 40 aa, Artificial Sequence
  Component of peptide hormone analogue
  MOD_RES (2)..(2): Aib
  MOD_RES (40)..(40): The residue at this position is Lys modified with a Y2 group attached to its epsilon amino group
HXHGTFTSDYSKYLDAKRAQEFIEWLLQSHHQHHESPPPK

SEQ ID NO: 320 - protein, 40 aa, Artificial Sequence
  Component of peptide hormone analogue
  MOD_RES (2)..(2): Aib
  MOD_RES (40)..(40): The residue at this position is Lys modified with a Y2 group attached to its epsilon amino group
HXHGTFTSDYSRYLDARRAQEFIEWLLQSHHQHHESPPPK

SEQ ID NO: 321 - protein, 41 aa, Artificial Sequence; identical to SEQ ID NO: 163
  Component of peptide hormone analogue
  MOD_RES (2)..(2): Aib
  MOD_RES (41)..(41): The residue at this position is Lys modified with a Y2 group attached to its epsilon amino group

SEQ ID NO: 322 - protein, 41 aa, Artificial Sequence
  Component of peptide hormone analogue
  MOD_RES (2)..(2): Aib
  MOD_RES (41)..(41): The residue at this position is Lys modified with a Y2 group attached to its epsilon amino group
HXHGTFTSDYSRYLDARRAQEFIEWLLQSHHHHHESPPPGK

SEQ ID NO: 323 - protein, 41 aa, Artificial Sequence
  Component of peptide hormone analogue
  MOD_RES (2)..(2): Aib
  MOD_RES (41)..(41): The residue at this position is Lys modified with a Y2 group attached to its epsilon amino group
HXHGTFTSDYSKYLDAKRAQEFIEWLLQSHHQHHESPPPGK

SEQ ID NO: 324 - protein, 41 aa, Artificial Sequence
  Component of peptide hormone analogue
  MOD_RES (2)..(2): Aib
  MOD_RES (41)..(41): The residue at this position is Lys modified with a Y2 group attached to its epsilon amino group
HXHGTFTSDYSRYLDARRAQEFIEWLLQSHHQHHESPPPGK

SEQ ID NO: 325 - protein, 41 aa, Artificial Sequence; identical to SEQ ID NO: 323
  Component of peptide hormone analogue
  MOD_RES (2)..(2): Aib
  MOD_RES (41)..(41): The residue at this position is Lys modified with a Y2 group attached to its epsilon amino group

SEQ ID NO: 326 - protein, 41 aa, Artificial Sequence; identical to SEQ ID NO: 324
  Component of peptide hormone analogue
  MOD_RES (2)..(2): Aib
  MOD_RES (41)..(41): The residue at this position is Lys modified with a Y2 group attached to its epsilon amino group

SEQ ID NO: 327 - protein, 40 aa, Artificial Sequence; identical to SEQ ID NO: 319
  Component of peptide hormone analogue
  MOD_RES (2)..(2): Aib
  MOD_RES (40)..(40): The residue at this position is Lys modified with a Y2 group attached to its epsilon amino group

SEQ ID NO: 328 - protein, 40 aa, Artificial Sequence; identical to SEQ ID NO: 320
  Component of peptide hormone analogue
  MOD_RES (2)..(2): Aib
  MOD_RES (40)..(40): The residue at this position is Lys modified with a Y2 group attached to its epsilon amino group

SEQ ID NO: 329 - protein, 41 aa, Artificial Sequence; identical to SEQ ID NO: 262
  Component of peptide hormone analogue
  MOD_RES (2)..(2): Aib
  MOD_RES (41)..(41): The residue at this position is Lys modified with a Y2 group attached to its epsilon amino group

SEQ ID NO: 330 - protein, 40 aa, Artificial Sequence; identical to SEQ ID NO: 320
  Component of peptide hormone analogue
  MOD_RES (2)..(2): Aib
  MOD_RES (40)..(40): The residue at this position is Lys modified with a Y2 group attached to its epsilon amino group

SEQ ID NO: 331 - protein, 41 aa, Artificial Sequence; identical to SEQ ID NO: 324
  Component of peptide hormone analogue
  MOD_RES (2)..(2): Aib
  MOD_RES (41)..(41): The residue at this position is Lys modified with a Y2 group attached to its epsilon amino group

SEQ ID NO: 332 - protein, 40 aa, Artificial Sequence; identical to SEQ ID NO: 318
  Component of peptide hormone analogue
  MOD_RES (2)..(2): Aib
  MOD_RES (40)..(40): The residue at this position is Lys modified with a Y2 group attached to its epsilon amino group

SEQ ID NO: 333 - protein, 41 aa, Artificial Sequence; identical to SEQ ID NO: 283
  Component of peptide hormone analogue
  MOD_RES (2)..(2): Aib
  MOD_RES (41)..(41): The residue at this position is Lys modified with a Y2 group attached to its epsilon amino group

SEQ ID NO: 334 - protein, 40 aa, Artificial Sequence
  Component of peptide hormone analogue
  MOD_RES (2)..(2): Aib
  MOD_RES (40)..(40): The residue at this position is Lys modified with a Y2 group attached to its epsilon amino group
HXHGTFTSDYSRYLDARRAQEFIEWLLQSHHHHHPSPPPK

SEQ ID NO: 335 - protein, 40 aa, Artificial Sequence; identical to SEQ ID NO: 320
  Component of peptide hormone analogue
  MOD_RES (2)..(2): Aib
  MOD_RES (40)..(40): The residue at this position is Lys modified with a Y2 group attached to its epsilon amino group

SEQ ID NO: 336 - protein, 41 aa, Artificial Sequence; identical to SEQ ID NO: 324
  Component of peptide hormone analogue
  MOD_RES (2)..(2): Aib
  MOD_RES (41)..(41): The residue at this position is Lys modified with a Y2 group attached to its epsilon amino group

SEQ ID NO: 337 - protein, 40 aa, Artificial Sequence; identical to SEQ ID NO: 318
  Component of peptide hormone analogue
  MOD_RES (2)..(2): Aib
  MOD_RES (40)..(40): The residue at this position is Lys modified with a Y2 group attached to its epsilon amino group

SEQ ID NO: 338 - protein, 41 aa, Artificial Sequence; identical to SEQ ID NO: 283
  Component of peptide hormone analogue
  MOD_RES (2)..(2): Aib
  MOD_RES (41)..(41): The residue at this position is Lys modified with a Y2 group attached to its epsilon amino group

SEQ ID NO: 339 - protein, 40 aa, Artificial Sequence; identical to SEQ ID NO: 334
  Component of peptide hormone analogue
  MOD_RES (2)..(2): Aib
  MOD_RES (40)..(40): The residue at this position is Lys modified with a Y2 group attached to its epsilon amino group

SEQ ID NO: 340 - protein, 41 aa, Artificial Sequence; identical to SEQ ID NO: 262
  Component of peptide hormone analogue
  MOD_RES (2)..(2): Aib
  MOD_RES (41)..(41): The residue at this position is Lys modified with a Y2 group attached to its epsilon amino group

SEQ ID NO: 341 - protein, 41 aa, Artificial Sequence; identical to SEQ ID NO: 136
  Component of peptide hormone analogue
  MOD_RES (2)..(2): Aib
  MOD_RES (41)..(41): The residue at this position is Lys modified with a Y2 group attached to its epsilon amino group

SEQ ID NO: 342 - protein, 40 aa, Artificial Sequence; identical to SEQ ID NO: 318
  Component of peptide hormone analogue
  MOD_RES (2)..(2): Aib
  MOD_RES (40)..(40): The residue at this position is Lys modified with a Y2 group attached to its epsilon amino group

SEQ ID NO: 343 - protein, 40 aa, Artificial Sequence; identical to SEQ ID NO: 318
  Component of peptide hormone analogue
  MOD_RES (2)..(2): Aib
  MOD_RES (40)..(40): The residue at this position is Lys modified with a Y2 group attached to its epsilon amino group

SEQ ID NO: 344 - protein, 40 aa, Artificial Sequence; identical to SEQ ID NO: 318
  Component of peptide hormone analogue
  MOD_RES (2)..(2): Aib
  MOD_RES (40)..(40): The residue at this position is Lys modified with a Y2 group attached to its epsilon amino group

SEQ ID NO: 345 - protein, 40 aa, Artificial Sequence; identical to SEQ ID NO: 318
  Component of peptide hormone analogue
  MOD_RES (2)..(2): Aib
  MOD_RES (40)..(40): The residue at this position is Lys modified with a Y2 group attached to its epsilon amino group

SEQ ID NO: 346 - protein, 40 aa, Artificial Sequence; identical to SEQ ID NO: 320
  Component of peptide hormone analogue
  MOD_RES (2)..(2): Aib
  MOD_RES (40)..(40): The residue at this position is Lys modified with a Y2 group attached to its epsilon amino group

SEQ ID NO: 347 - protein, 40 aa, Artificial Sequence; identical to SEQ ID NO: 318
  Component of peptide hormone analogue
  MOD_RES (2)..(2): Aib
  MOD_RES (40)..(40): The residue at this position is Lys modified with a Y2 group attached to its epsilon amino group

SEQ ID NO: 348 - protein, 40 aa, Artificial Sequence; identical to SEQ ID NO: 318
  Component of peptide hormone analogue
  MOD_RES (2)..(2): Aib
  MOD_RES (40)..(40): The residue at this position is Lys modified with a Y2 group attached to its epsilon amino group

SEQ ID NO: 349 - protein, 40 aa, Artificial Sequence; identical to SEQ ID NO: 318
  Component of peptide hormone analogue
  MOD_RES (2)..(2): Aib
  MOD_RES (40)..(40): The residue at this position is Lys modified with a Y2 group attached to its epsilon amino group

SEQ ID NO: 350 - protein, 41 aa, Artificial Sequence; identical to SEQ ID NO: 324
  Component of peptide hormone analogue
  MOD_RES (2)..(2): Aib
  MOD_RES (41)..(41): The residue at this position is Lys modified with a Y2 group attached to its epsilon amino group

SEQ ID NO: 351 - protein, 41 aa, Artificial Sequence; identical to SEQ ID NO: 283
  Component of peptide hormone analogue
  MOD_RES (2)..(2): Aib
  MOD_RES (41)..(41): The residue at this position is Lys modified with a Y2 group attached to its epsilon amino group

SEQ ID NO: 352 - protein, 41 aa, Artificial Sequence; identical to SEQ ID NO: 283
  Component of peptide hormone analogue
  MOD_RES (2)..(2): Aib
  MOD_RES (41)..(41): The residue at this position is Lys modified with a Y2 group attached to its epsilon amino group

SEQ ID NO: 353 - protein, 41 aa, Artificial Sequence; identical to SEQ ID NO: 283
  Component of peptide hormone analogue
  MOD_RES (2)..(2): Aib
  MOD_RES (41)..(41): The residue at this position is Lys modified with a Y2 group attached to its epsilon amino group

SEQ ID NO: 354 - protein, 41 aa, Artificial Sequence; identical to SEQ ID NO: 275
  Component of peptide hormone analogue
  MOD_RES (2)..(2): Aib
  MOD_RES (41)..(41): The residue at this position is Lys modified with a Y2 group attached to its epsilon amino group

SEQ ID NO: 355 - protein, 41 aa, Artificial Sequence; identical to SEQ ID NO: 283
  Component of peptide hormone analogue
  MOD_RES (2)..(2): Aib
  MOD_RES (41)..(41): The residue at this position is Lys modified with a Y2 group attached to its epsilon amino group

SEQ ID NO: 356 - protein, 41 aa, Artificial Sequence; identical to SEQ ID NO: 283
  Component of peptide hormone analogue
  MOD_RES (2)..(2): Aib
  MOD_RES (41)..(41): The residue at this position is Lys modified with a Y2 group attached to its epsilon amino group

SEQ ID NO: 357 - protein, 41 aa, Artificial Sequence; identical to SEQ ID NO: 283
  Component of peptide hormone analogue
  MOD_RES (2)..(2): Aib
  MOD_RES (41)..(41): The residue at this position is Lys modified with a Y2 group attached to its epsilon amino group

SEQ ID NO: 358 - protein, 41 aa, Artificial Sequence; identical to SEQ ID NO: 283
  Component of peptide hormone analogue
  MOD_RES (2)..(2): Aib
  MOD_RES (41)..(41): The residue at this position is Lys modified with a Y2 group attached to its epsilon amino group

SEQ ID NO: 359 - protein, 41 aa, Artificial Sequence; identical to SEQ ID NO: 283
  Component of peptide hormone analogue
  MOD_RES (2)..(2): Aib
  MOD_RES (41)..(41): The residue at this position is Lys modified with a Y2 group attached to its epsilon amino group

SEQ ID NO: 360 - protein, 41 aa, Artificial Sequence; identical to SEQ ID NO: 283
  Component of peptide hormone analogue
  MOD_RES (2)..(2): Aib
  MOD_RES (41)..(41): The residue at this position is Lys modified with a Y2 group attached to its epsilon amino group

SEQ ID NO: 361 - protein, 40 aa, Artificial Sequence; identical to SEQ ID NO: 318
  Component of peptide hormone analogue
  MOD_RES (2)..(2): Aib
  MOD_RES (40)..(40): The residue at this position is Lys modified with a Y2 group attached to its epsilon amino group

SEQ ID NO: 362 - protein, 40 aa, Artificial Sequence; identical to SEQ ID NO: 318
  Component of peptide hormone analogue
  MOD_RES (2)..(2): Aib
  MOD_RES (40)..(40): The residue at this position is Lys modified with a Y2 group attached to its epsilon amino group

SEQ ID NO: 363 - protein, 38 aa, Artificial Sequence
  Component of peptide hormone analogue
  MOD_RES (2)..(2): Aib
  MOD_RES (38)..(38): The residue at this position is Lys modified with a Y2 group attached to its epsilon amino group
HXHGTFTSDYSRYLDERRAHEFIEWLLHGHHQHHASGK

SEQ ID NO: 364 - protein, 38 aa, Artificial Sequence; identical to SEQ ID NO: 85
  Component of peptide hormone analogue
  MOD_RES (2)..(2): Aib
  MOD_RES (38)..(38): The residue at this position is Lys modified with a Y2 group attached to its epsilon amino group

SEQ ID NO: 365 - protein, 38 aa, Artificial Sequence; identical to SEQ ID NO: 363
  Component of peptide hormone analogue
  MOD_RES (2)..(2): Aib
  MOD_RES (38)..(38): The residue at this position is Lys modified with a Y2 group attached to its epsilon amino group

SEQ ID NO: 366 - protein, 40 aa, Artificial Sequence; identical to SEQ ID NO: 317
  Component of peptide hormone analogue
  MOD_RES (2)..(2): Aib
  MOD_RES (40)..(40): The residue at this position is Lys modified with a Y2 group attached to its epsilon amino group

SEQ ID NO: 367 - protein, 40 aa, Artificial Sequence; identical to SEQ ID NO: 317
  Component of peptide hormone analogue
  MOD_RES (2)..(2): Aib
  MOD_RES (40)..(40): The residue at this position is Lys modified with a Y2 group attached to its epsilon amino group

SEQ ID NO: 368 - protein, 40 aa, Artificial Sequence; identical to SEQ ID NO: 317
  Component of peptide hormone analogue
  MOD_RES (2)..(2): Aib
  MOD_RES (40)..(40): The residue at this position is Lys modified with a Y2 group attached to its epsilon amino group

SEQ ID NO: 369 - protein, 40 aa, Artificial Sequence; identical to SEQ ID NO: 317
  Component of peptide hormone analogue
  MOD_RES (2)..(2): Aib
  MOD_RES (40)..(40): The residue at this position is Lys modified with a Y2 group attached to its epsilon amino group

SEQ ID NO: 370 - protein, 40 aa, Artificial Sequence
  Component of peptide hormone analogue
  MOD_RES (2)..(2): Aib
  MOD_RES (40)..(40): The residue at this position is Lys modified with a Y2 group attached to its epsilon amino group
HXHGTFTSDYSRYLDAKRAQEFIEWLLQSHHQHHPSPPPK

SEQ ID NO: 371 - protein, 40 aa, Artificial Sequence; identical to SEQ ID NO: 370
  Component of peptide hormone analogue
  MOD_RES (2)..(2): Aib
  MOD_RES (40)..(40): The residue at this position is Lys modified with a Y2 group attached to its epsilon amino group

SEQ ID NO: 372 - protein, 40 aa, Artificial Sequence; identical to SEQ ID NO: 370
  Component of peptide hormone analogue
  MOD_RES (2)..(2): Aib
  MOD_RES (40)..(40): The residue at this position is Lys modified with a Y2 group attached to its epsilon amino group

SEQ ID NO: 373 - protein, 40 aa, Artificial Sequence; identical to SEQ ID NO: 370
  Component of peptide hormone analogue
  MOD_RES (2)..(2): Aib
  MOD_RES (40)..(40): The residue at this position is Lys modified with a Y2 group attached to its epsilon amino group

SEQ ID NO: 374 - protein, 40 aa, Artificial Sequence; identical to SEQ ID NO: 370
  Component of peptide hormone analogue
  MOD_RES (2)..(2): Aib
  MOD_RES (40)..(40): The residue at this position is Lys modified with a Y2 group attached to its epsilon amino group

SEQ ID NO: 375 - protein, 41 aa, Artificial Sequence
  Component of peptide hormone analogue
  MOD_RES (2)..(2): Aib
  MOD_RES (41)..(41): The residue at this position is Lys modified with a Y2 group attached to its epsilon amino group
HXHGTFTSDYSRYLDAKRAQEFIEWLLQSHHQHHPSPPPGK

SEQ ID NO: 376 - protein, 41 aa, Artificial Sequence; identical to SEQ ID NO: 375
  Component of peptide hormone analogue
  MOD_RES (2)..(2): Aib
  MOD_RES (41)..(41): The residue at this position is Lys modified with a Y2 group attached to its epsilon amino group

SEQ ID NO: 377 - protein, 41 aa, Artificial Sequence; identical to SEQ ID NO: 375
  Component of peptide hormone analogue
  MOD_RES (2)..(2): Aib
  MOD_RES (41)..(41): The residue at this position is Lys modified with a Y2 group attached to its epsilon amino group

SEQ ID NO: 378 - protein, 41 aa, Artificial Sequence; identical to SEQ ID NO: 375
  Component of peptide hormone analogue
  MOD_RES (2)..(2): Aib
  MOD_RES (41)..(41): The residue at this position is Lys modified with a Y2 group attached to its epsilon amino group

SEQ ID NO: 379 - protein, 41 aa, Artificial Sequence; identical to SEQ ID NO: 375
  Component of peptide hormone analogue
  MOD_RES (2)..(2): Aib
  MOD_RES (41)..(41): The residue at this position is Lys modified with a Y2 group attached to its epsilon amino group

SEQ ID NO: 380 - protein, 40 aa, Artificial Sequence; identical to SEQ ID NO: 370
  Component of peptide hormone analogue
  MOD_RES (2)..(2): Aib
  MOD_RES (40)..(40): The residue at this position is Lys modified with a Y2 group attached to its epsilon amino group

SEQ ID NO: 381 - protein, 40 aa, Artificial Sequence; identical to SEQ ID NO: 370
  Component of peptide hormone analogue
  MOD_RES (2)..(2): Aib
  MOD_RES (40)..(40): The residue at this position is Lys modified with a Y2 group attached to its epsilon amino group

SEQ ID NO: 382 - protein, 40 aa, Artificial Sequence; identical to SEQ ID NO: 370
  Component of peptide hormone analogue
  MOD_RES (2)..(2): Aib
  MOD_RES (40)..(40): The residue at this position is Lys modified with a Y2 group attached to its epsilon amino group

SEQ ID NO: 383 - protein, 40 aa, Artificial Sequence; identical to SEQ ID NO: 370
  Component of peptide hormone analogue
  MOD_RES (2)..(2): Aib
  MOD_RES (40)..(40): The residue at this position is Lys modified with a Y2 group attached to its epsilon amino group

SEQ ID NO: 384 - protein, 40 aa, Artificial Sequence; identical to SEQ ID NO: 370
  Component of peptide hormone analogue
  MOD_RES (2)..(2): Aib
  MOD_RES (40)..(40): The residue at this position is Lys modified with a Y2 group attached to its epsilon amino group

SEQ ID NO: 385 - protein, 38 aa, Artificial Sequence
  Component of peptide hormone analogue
  MOD_RES (2)..(2): Aib
  MOD_RES (38)..(38): The residue at this position is Lys modified with a Y2 group attached to its epsilon amino group
HXHGTFTSDYSRYLDEKRAHEFIEWLLHGHHQHHASGK

SEQ ID NO: 386 - protein, 38 aa, Artificial Sequence; identical to SEQ ID NO: 385
  Component of peptide hormone analogue
  MOD_RES (2)..(2): Aib
  MOD_RES (38)..(38): The residue at this position is Lys modified with a Y2 group attached to its epsilon amino group

SEQ ID NO: 387 - protein, 38 aa, Artificial Sequence; identical to SEQ ID NO: 385
  Component of peptide hormone analogue
  MOD_RES (2)..(2): Aib
  MOD_RES (38)..(38): The residue at this position is Lys modified with a Y2 group attached to its epsilon amino group

SEQ ID NO: 388 - protein, 40 aa, Artificial Sequence; identical to SEQ ID NO: 318
  Component of peptide hormone analogue
  MOD_RES (2)..(2): Aib
  MOD_RES (40)..(40): The residue at this position is Lys modified with a Y2 group attached to its epsilon amino group

SEQ ID NO: 389 - protein, 40 aa, Artificial Sequence; identical to SEQ ID NO: 317
  Component of peptide hormone analogue
  MOD_RES (2)..(2): Aib
  MOD_RES (40)..(40): The residue at this position is Lys modified with a Y2 group attached to its epsilon amino group

SEQ ID NO: 390 - protein, 40 aa, Artificial Sequence; identical to SEQ ID NO: 318
  Component of peptide hormone analogue
  MOD_RES (2)..(2): Aib
  MOD_RES (40)..(40): The residue at this position is Lys modified with a Y2 group attached to its epsilon amino group

SEQ ID NO: 391 - protein, 40 aa, Artificial Sequence; identical to SEQ ID NO: 317
  Component of peptide hormone analogue
  MOD_RES (2)..(2): Aib
  MOD_RES (40)..(40): The residue at this position is Lys modified with a Y2 group attached to its epsilon amino group

SEQ ID NO: 392 - protein, 41 aa, Artificial Sequence; identical to SEQ ID NO: 262
  Component of peptide hormone analogue
  MOD_RES (2)..(2): Aib
  MOD_RES (41)..(41): The residue at this position is Lys modified with a Y2 group attached to its epsilon amino group

SEQ ID NO: 393 - protein, 41 aa, Artificial Sequence; identical to SEQ ID NO: 262
  Component of peptide hormone analogue
  MOD_RES (2)..(2): Aib
  MOD_RES (41)..(41): The residue at this position is Lys modified with a Y2 group attached to its epsilon amino group

SEQ ID NO: 394 - protein, 41 aa, Artificial Sequence; identical to SEQ ID NO: 375
  Component of peptide hormone analogue
  MOD_RES (2)..(2): Aib
  MOD_RES (41)..(41): The residue at this position is Lys modified with a Y2 group attached to its epsilon amino group

SEQ ID NO: 395 - protein, 41 aa, Artificial Sequence; identical to SEQ ID NO: 375
  Component of peptide hormone analogue
  MOD_RES (2)..(2): Aib
  MOD_RES (41)..(41): The residue at this position is Lys modified with a Y2 group attached to its epsilon amino group

SEQ ID NO: 396 - protein, 40 aa, Artificial Sequence; identical to SEQ ID NO: 370
  Component of peptide hormone analogue
  MOD_RES (2)..(2): Aib
  MOD_RES (40)..(40): The residue at this position is Lys modified with a Y2 group attached to its epsilon amino group

SEQ ID NO: 397 - protein, 40 aa, Artificial Sequence; identical to SEQ ID NO: 370
  Component of peptide hormone analogue
  MOD_RES (2)..(2): Aib
  MOD_RES (40)..(40): The residue at this position is Lys modified with a Y2 group attached to its epsilon amino group

SEQ ID NO: 398 - protein, 40 aa, Artificial Sequence; identical to SEQ ID NO: 317
  Component of peptide hormone analogue
  MOD_RES (2)..(2): Aib
  MOD_RES (40)..(40): The residue at this position is Lys modified with a Y2 group attached to its epsilon amino group

SEQ ID NO: 399 - protein, 40 aa, Artificial Sequence; identical to SEQ ID NO: 317
  Component of peptide hormone analogue
  MOD_RES (2)..(2): Aib
  MOD_RES (40)..(40): The residue at this position is Lys modified with a Y2 group attached to its epsilon amino group

SEQ ID NO: 400 - protein, 41 aa, Artificial Sequence; identical to SEQ ID NO: 262
  Component of peptide hormone analogue
  MOD_RES (2)..(2): Aib
  MOD_RES (41)..(41): The residue at this position is Lys modified with a Y2 group attached to its epsilon amino group

SEQ ID NO: 401 - protein, 41 aa, Artificial Sequence; identical to SEQ ID NO: 136
  Component of peptide hormone analogue
  MOD_RES (2)..(2): Aib
  MOD_RES (41)..(41): The residue at this position is Lys modified with a Y2 group attached to its epsilon amino group

SEQ ID NO: 402 - protein, 41 aa, Artificial Sequence; identical to SEQ ID NO: 107
  Component of peptide hormone analogue
  MOD_RES (2)..(2): Aib
  MOD_RES (41)..(41): The residue at this position is Lys modified with a Y2 group attached to its epsilon amino group

SEQ ID NO: 403 - protein, 40 aa, Artificial Sequence; identical to SEQ ID NO: 319
  Component of peptide hormone analogue
  MOD_RES (2)..(2): Aib
  MOD_RES (40)..(40): The residue at this position is Lys modified with a Y2 group attached to its epsilon amino group

SEQ ID NO: 404 - protein, 41 aa, Artificial Sequence; identical to SEQ ID NO: 323
  Component of peptide hormone analogue
  MOD_RES (2)..(2): Aib
  MOD_RES (41)..(41): The residue at this position is Lys modified with a Y2 group attached to its epsilon amino group

SEQ ID NO: 405 - protein, 37 aa, Artificial Sequence
  Component of peptide hormone analogue
  MOD_RES (2)..(2): Aib
  MOD_RES (37)..(37): The residue at this position is Lys modified with a Y2 group attached to its epsilon amino group
HXHGTFTSDYSKYLDQRRAHEFIEWLLNSGHHHHHTK

SEQ ID NO: 406 - protein, 37 aa, Artificial Sequence; identical to SEQ ID NO: 405
  Component of peptide hormone analogue
  MOD_RES (2)..(2): Aib
  MOD_RES (37)..(37): The residue at this position is Lys modified with a Y2 group attached to its epsilon amino group

SEQ ID NO: 407 - protein, 41 aa, Artificial Sequence; identical to SEQ ID NO: 136
  Component of peptide hormone analogue
  MOD_RES (2)..(2): Aib
  MOD_RES (41)..(41): The residue at this position is Lys modified with a Y2 group attached to its epsilon amino group

SEQ ID NO: 408 - protein, 40 aa, Artificial Sequence; identical to SEQ ID NO: 317
  Component of peptide hormone analogue
  MOD_RES (2)..(2): Aib
  MOD_RES (40)..(40): The residue at this position is Lys modified with a Y2 group attached to its epsilon amino group

SEQ ID NO: 409 - protein, 40 aa, Artificial Sequence; identical to SEQ ID NO: 370
  Component of peptide hormone analogue
  MOD_RES (2)..(2): Aib
  MOD_RES (40)..(40): The residue at this position is Lys modified with a Y2 group attached to its epsilon amino group

SEQ ID NO: 410 - protein, 41 aa, Artificial Sequence; identical to SEQ ID NO: 375
  Component of peptide hormone analogue
  MOD_RES (2)..(2): Aib
  MOD_RES (41)..(41): The residue at this position is Lys modified with a Y2 group attached to its epsilon amino group

SEQ ID NO: 411 - protein, 40 aa, Artificial Sequence; identical to SEQ ID NO: 317
  Component of peptide hormone analogue
  MOD_RES (2)..(2): Aib
  MOD_RES (40)..(40): The residue at this position is Lys modified with a Y2 group attached to its epsilon amino group

SEQ ID NO: 412 - protein, 40 aa, Artificial Sequence; identical to SEQ ID NO: 317
  Component of peptide hormone analogue
  MOD_RES (2)..(2): Aib
  MOD_RES (40)..(40): The residue at this position is Lys modified with a Y2 group attached to its epsilon amino group

SEQ ID NO: 413 - protein, 40 aa, Artificial Sequence; identical to SEQ ID NO: 317
  Component of peptide hormone analogue
  MOD_RES (2)..(2): Aib
  MOD_RES (40)..(40): The residue at this position is Lys modified with a Y2 group attached to its epsilon amino group

SEQ ID NO: 414 - protein, 40 aa, Artificial Sequence; identical to SEQ ID NO: 317
  Component of peptide hormone analogue
  MOD_RES (2)..(2): Aib
  MOD_RES (40)..(40): The residue at this position is Lys modified with a Y2 group attached to its epsilon amino group

SEQ ID NO: 415 - protein, 40 aa, Artificial Sequence
  Component of peptide hormone analogue
  MOD_RES (2)..(2): Aib
  MOD_RES (40)..(40): The residue at this position is Lys modified with a Y2 group attached to its epsilon amino group
HXHGTFTSDYSKYLDQKRAQEFIEWLLQSHHQHHPSPPPK

SEQ ID NO: 416 - protein, 40 aa, Artificial Sequence
  Component of peptide hormone analogue
  MOD_RES (2)..(2): Aib
  MOD_RES (40)..(40): The residue at this position is Lys modified with a Y2 group attached to its epsilon amino group
HXHGTFTSDYSKYLDEKRAQEFIEWLLQSHHQHHPSPPPK

SEQ ID NO: 417 - protein, 40 aa, Artificial Sequence
  Component of peptide hormone analogue
  MOD_RES (2)..(2): Aib
  MOD_RES (40)..(40): The residue at this position is Lys modified with a Y2 group attached to its epsilon amino group
HXQGTFTSDYSKYLDAKRAQEFIEWLLQSHHQHHPSPPPK

SEQ ID NO: 418 - protein, 40 aa, Artificial Sequence
  Component of peptide hormone analogue
  MOD_RES (2)..(2): Aib
  MOD_RES (40)..(40): The residue at this position is Lys modified with a Y2 group attached to its epsilon amino group
HXEGTFTSDYSKYLDAKRAQEFIEWLLQSHHQHHPSPPPK

SEQ ID NO: 419 - protein, 40 aa, Artificial Sequence
  Component of peptide hormone analogue
  MOD_RES (2)..(2): Aib
  MOD_RES (40)..(40): The residue at this position is Lys modified with a Y2 group attached to its epsilon amino group
HXQGTFTSDYSKYLDEKRAQEFIEWLLQSHHQHHPSPPPK

SEQ ID NO: 420 - protein, 40 aa, Artificial Sequence
  Component of peptide hormone analogue
  MOD_RES (2)..(2): Aib
  MOD_RES (40)..(40): The residue at this position is Lys modified with a Y2 group attached to its epsilon amino group
HXHGTFTSDYSRYLDQKRAQEFIEWLLQSHHQHHPSPPPK

SEQ ID NO: 421 - protein, 40 aa, Artificial Sequence
  Component of peptide hormone analogue
  MOD_RES (2)..(2): Aib
  MOD_RES (40)..(40): The residue at this position is Lys modified with a Y2 group attached to its epsilon amino group
HXHGTFTSDYSRYLDQRRAQEFIEWLLQSHHQHHPSPPPK

SEQ ID NO: 422 - protein, 41 aa, Artificial Sequence
  Component of peptide hormone analogue
  MOD_RES (2)..(2): Aib
  MOD_RES (41)..(41): The residue at this position is Lys modified with a Y2 group attached to its epsilon amino group
HXHGTFTSDYSKYLDQKRAQEFIEWLLQSHHQHHESPPPGK

SEQ ID NO: 423 - protein, 41 aa, Artificial Sequence
  Component of peptide hormone analogue
  MOD_RES (2)..(2): Aib
  MOD_RES (41)..(41): The residue at this position is Lys modified with a Y2 group attached to its epsilon amino group
HXHGTFTSDYSKYLDEKRAQEFIEWLLQSHHQHHESPPPGK

SEQ ID NO: 424 - protein, 41 aa, Artificial Sequence
  Component of peptide hormone analogue
  MOD_RES (2)..(2): Aib
  MOD_RES (41)..(41): The residue at this position is Lys modified with a Y2 group attached to its epsilon amino group
HXQGTFTSDYSKYLDAKRAQEFIEWLLQSHHQHHESPPPGK

SEQ ID NO: 425 - protein, 41 aa, Artificial Sequence
  Component of peptide hormone analogue
  MOD_RES (2)..(2): Aib
  MOD_RES (41)..(41): The residue at this position is Lys modified with a Y2 group attached to its epsilon amino group
HXQGTFTSDYSKYLDEKRAQEFIEWLLQSHHQHHESPPPGK

SEQ ID NO: 426 - protein, 41 aa, Artificial Sequence; identical to SEQ ID NO: 323
  Component of peptide hormone analogue
  MOD_RES (2)..(2): Aib
  MOD_RES (41)..(41): The residue at this position is Lys modified with a Y2 group attached to its epsilon amino group

SEQ ID NO: 427 - protein, 40 aa, Artificial Sequence
  Component of peptide hormone analogue
  MOD_RES (2)..(2): Aib
  MOD_RES (40)..(40): The residue at this position is Lys modified with a Y2 group attached to its epsilon amino group
HXHGTFTSDYSKYLDEKRAHEFIEWLLHGHHHHHESPPPK

SEQ ID NO: 428 - protein, 40 aa, Artificial Sequence
  Component of peptide hormone analogue
  MOD_RES (2)..(2): Aib
  MOD_RES (40)..(40): The residue at this position is Lys modified with a Y2 group attached to its epsilon amino group
HXHGTFTSDYSKYLDEKRAHEFIEWLLHGHHQHHESPPPK

SEQ ID NO: 429 - protein, 40 aa, Artificial Sequence; identical to SEQ ID NO: 428
  Component of peptide hormone analogue
  MOD_RES (2)..(2): Aib
  MOD_RES (40)..(40): The residue at this position is Lys modified with a Y2 group attached to its epsilon amino group

SEQ ID NO: 430 - protein, 40 aa, Artificial Sequence; identical to SEQ ID NO: 428
  Component of peptide hormone analogue
  MOD_RES (2)..(2): Aib
  MOD_RES (40)..(40): The residue at this position is Lys modified with a Y2 group attached to its epsilon amino group

SEQ ID NO: 431 - protein, 41 aa, Artificial Sequence
  Component of peptide hormone analogue
  MOD_RES (2)..(2): Aib
  MOD_RES (41)..(41): The residue at this position is Lys modified with a Y2 group attached to its epsilon amino group
HXHGTFTSDYSKYLDEKRAHEFIEWLLHGHHQHHESPPPGK

SEQ ID NO: 432 - protein, 41 aa, Artificial Sequence; identical to SEQ ID NO: 431
  Component of peptide hormone analogue
  MOD_RES (2)..(2): Aib
  MOD_RES (41)..(41): The residue at this position is Lys modified with a Y2 group attached to its epsilon amino group

SEQ ID NO: 433 - protein, 41 aa, Artificial Sequence; identical to SEQ ID NO: 431
  Component of peptide hormone analogue
  MOD_RES (2)..(2): Aib
  MOD_RES (41)..(41): The residue at this position is Lys modified with a Y2 group attached to its epsilon amino group

SEQ ID NO: 434 - protein, 41 aa, Artificial Sequence
  Component of peptide hormone analogue
  MOD_RES (2)..(2): Aib
  MOD_RES (41)..(41): The residue at this position is Lys modified with a Y2 group attached to its epsilon amino group
HXHGTFTSDYSRYLDERRAHEFIEWLLHGHHQHHESPPPGK

SEQ ID NO: 435 - protein, 41 aa, Artificial Sequence; identical to SEQ ID NO: 207
  Component of peptide hormone analogue
  MOD_RES (2)..(2): Aib
  MOD_RES (41)..(41): The residue at this position is Lys modified with a Y2 group attached to its epsilon amino group

SEQ ID NO: 436 - protein, 37 aa, Artificial Sequence; identical to SEQ ID NO: 405
  Component of peptide hormone analogue
  MOD_RES (2)..(2): Aib
  MOD_RES (37)..(37): The residue at this position is Lys modified with a Y2 group attached to its epsilon amino group

SEQ ID NO: 437 - protein, 38 aa, Artificial Sequence; identical to SEQ ID NO: 385
  Component of peptide hormone analogue
  MOD_RES (2)..(2): Aib
  MOD_RES (38)..(38): The residue at this position is Lys modified with a Y2 group attached to its epsilon amino group

SEQ ID NO: 438 - protein, 38 aa, Artificial Sequence; identical to SEQ ID NO: 363
  Component of peptide hormone analogue
  MOD_RES (2)..(2): Aib
  MOD_RES (38)..(38): The residue at this position is Lys modified with a Y2 group attached to its epsilon amino group

SEQ ID NO: 439 - protein, 41 aa, Artificial Sequence
  Component of peptide hormone analogue
  MOD_RES (2)..(2): Aib
  MOD_RES (41)..(41): The residue at this position is Lys modified with a Y2 group attached to its epsilon amino group
HXHGTFTSDYSRYLDERRAQEFIEWLLQSHHQHHPSPPPGK

SEQ ID NO: 440 - protein, 40 aa, Artificial Sequence
  Component of peptide hormone analogue
  MOD_RES (2)..(2): Aib
  MOD_RES (40)..(40): The residue at this position is Lys modified with a Y2 group attached to its epsilon amino group
HXHGTFTSDYSRYLDERRAQEFIEWLLQSHHQHHPSPPPK

SEQ ID NO: 441 - protein, 40 aa, Artificial Sequence
  Component of peptide hormone analogue
  MOD_RES (2)..(2): Aib
  MOD_RES (40)..(40): The residue at this position is Lys modified with a Y2 group attached to its epsilon amino group
HXHGTFTSDYSRYLDERRAQEFIEWLLQSHHQHHESPPPK

SEQ ID NO: 442 - protein, 40 aa, Artificial Sequence
  Component of peptide hormone analogue
  MOD_RES (2)..(2): Aib
  MOD_RES (40)..(40): The residue at this position is Lys modified with a Y2 group attached to its epsilon amino group
HXHGTFTSDYSKYLDERRAQEFIEWLLQSHHQHHPSPPPK

SEQ ID NO: 443 - protein, 40 aa, Artificial Sequence
  Component of peptide hormone analogue
  MOD_RES (2)..(2): Aib
  MOD_RES (40)..(40): The residue at this position is Lys modified with a Y2 group attached to its epsilon amino group
HXHGTFTSDYSKYLDAKRAHEFIEWLLHGHHQHHPSPPPK

SEQ ID NO: 444 - protein, 40 aa, Artificial Sequence
  Component of peptide hormone analogue
  MOD_RES (2)..(2): Aib
  MOD_RES (40)..(40): The residue at this position is Lys modified with a Y2 group attached to its epsilon amino group
HXHGTFTSDYSKYLDEKRAHEFIEWLLHGHHQHHPSPPPK

SEQ ID NO: 445 - protein, 40 aa, Artificial Sequence
  Component of peptide hormone analogue
  MOD_RES (2)..(2): Aib
  MOD_RES (40)..(40): The residue at this position is Lys modified with a Y2 group attached to its epsilon amino group
HXHGTFTSDYSKYLDEKRAQEFIEWLLQSHHQHHESPPPK

SEQ ID NO: 446 - protein, 40 aa, Artificial Sequence
  Component of peptide hormone analogue
  MOD_RES (2)..(2): Aib
  MOD_RES (40)..(40): The residue at this position is Lys modified with a Y2 group attached to its epsilon amino group
HXHGTFTSDYSKYLDERRAQEFIEWLLQSHHQHHESPPPK

SEQ ID NO: 447 - protein, 40 aa, Artificial Sequence; identical to SEQ ID NO: 318
  Component of peptide hormone analogue
  MOD_RES (2)..(2): Aib
  MOD_RES (40)..(40): The residue at this position is Lys modified with a Y2 group attached to its epsilon amino group

SEQ ID NO: 448 - protein, 40 aa, Artificial Sequence; identical to SEQ ID NO: 440
  Component of peptide hormone analogue
  MOD_RES (2)..(2): Aib
  MOD_RES (40)..(40): The residue at this position is Lys modified with a Y2 group attached to its epsilon amino group

SEQ ID NO: 449 - protein, 42 aa, Artificial Sequence
  Component of peptide hormone analogue
  MOD_RES (2)..(2): Aib
  MOD_RES (42)..(42): The residue at this position is Lys modified with a Y2 group attached to its epsilon amino group
HXHGTFTSDYSKYLDAKRAQEFIEWLLQSHHHHHESPPPSGK

SEQ ID NO: 450 - protein, 40 aa, Artificial Sequence
  Component of peptide hormone analogue
  MOD_RES (2)..(2): Aib
  MOD_RES (40)..(40): The residue at this position is Lys modified with a Y2 group attached to its epsilon amino group
HXHGTFTSDYSKYLDARRAQEFIEWLLQSHHQHHESPPPK

SEQ ID NO: 451 - protein, 40 aa, Artificial Sequence; identical to SEQ ID NO: 446
  Component of peptide hormone analogue
  MOD_RES (2)..(2): Aib
  MOD_RES (40)..(40): The residue at this position is Lys modified with a Y2 group attached to its epsilon amino group

SEQ ID NO: 452 - protein, 40 aa, Artificial Sequence
  Component of peptide hormone analogue
  MOD_RES (2)..(2): Aib
  MOD_RES (40)..(40): The residue at this position is Lys modified with a Y2 group attached to its epsilon amino group
HXHGTFTSDYSKYLDERRAHEFIEWLLHGHHQHHPSPPPK

SEQ ID NO: 453 - protein, 40 aa, Artificial Sequence
  Component of peptide hormone analogue
  MOD_RES (2)..(2): Aib
  MOD_RES (40)..(40): The residue at this position is Lys modified with a Y2 group attached to its epsilon amino group
HXHGTFTSDYSRYLDERRAHEFIEWLLHGHHQHHESPPPK

SEQ ID NO: 454 - protein, 40 aa, Artificial Sequence; identical to SEQ ID NO: 450
  Component of peptide hormone analogue
  MOD_RES (2)..(2): Aib
  MOD_RES (40)..(40): The residue at this position is Lys modified with a Y2 group attached to its epsilon amino group

SEQ ID NO: 455 - protein, 40 aa, Artificial Sequence; identical to SEQ ID NO: 446
  Component of peptide hormone analogue
  MOD_RES (2)..(2): Aib
  MOD_RES (40)..(40): The residue at this position is Lys modified with a Y2 group attached to its epsilon amino group

SEQ ID NO: 456 - protein, 40 aa, Artificial Sequence; identical to SEQ ID NO: 452
  Component of peptide hormone analogue
  MOD_RES (2)..(2): Aib
  MOD_RES (40)..(40): The residue at this position is Lys modified with a Y2 group attached to its epsilon amino group

SEQ ID NO: 457 - protein, 40 aa, Artificial Sequence; identical to SEQ ID NO: 453
  Component of peptide hormone analogue
  MOD_RES (2)..(2): Aib
  MOD_RES (40)..(40): The residue at this position is Lys modified with a Y2 group attached to its epsilon amino group

SEQ ID NO: 458 - protein, 40 aa, Artificial Sequence
  Component of peptide hormone analogue
  MOD_RES (2)..(2): Aib
  MOD_RES (40)..(40): The residue at this position is Lys modified with a Y2 group attached to its epsilon amino group
HXHGTFTSDYSKYLDQRRAHEFIEWLLHGHHQHHPSPPPK

SEQ ID NO: 459 - protein, 41 aa, Artificial Sequence; identical to SEQ ID NO: 107
  Component of peptide hormone analogue
  MOD_RES (2)..(2): Aib
  MOD_RES (41)..(41): The residue at this position is Lys modified with a Y2 group attached to its epsilon amino group

SEQ ID NO: 460 - protein, 40 aa, Artificial Sequence
  Component of peptide hormone analogue
  MOD_RES (2)..(2): Aib
  MOD_RES (40)..(40): The residue at this position is Lys modified with a Y2 group attached to its epsilon amino group
HXHGTFTSDYSRYLDARRAQEFIEWLLQSHQQQHPSPPPK

SEQ ID NO: 461 - protein, 40 aa, Artificial Sequence; identical to SEQ ID NO: 421
  Component of peptide hormone analogue
  MOD_RES (2)..(2): Aib
  MOD_RES (40)..(40): The residue at this position is Lys modified with a Y2 group attached to its epsilon amino group

SEQ ID NO: 462 - protein, 40 aa, Artificial Sequence
  Component of peptide hormone analogue
  MOD_RES (2)..(2): Aib
  MOD_RES (40)..(40): The residue at this position is Lys modified with a Y2 group attached to its epsilon amino group
HXQGTFTSDYSRYLDARRAQEFIEWLLQSHQQQHPSPPPK

SEQ ID NO: 463 - protein, 38 aa, Artificial Sequence
  Component of peptide hormone analogue
  MOD_RES (2)..(2): Aib
  MOD_RES (38)..(38): The residue at this position is Lys modified with a Y2 group attached to its epsilon amino group
HXHGTFTSDYSKYLDERRAQDFIEWLLQSHQHPSPPPK

SEQ ID NO: 464 - protein, 38 aa, Artificial Sequence
  Component of peptide hormone analogue
  MOD_RES (2)..(2): Aib
  MOD_RES (38)..(38): The residue at this position is Lys modified with a Y2 group attached to its epsilon amino group
HXHGTFTSDYSRYLDARRAQEFIEWLLQSHQHESPPPK

SEQ ID NO: 465 - protein, 38 aa, Artificial Sequence; identical to SEQ ID NO: 464
  Component of peptide hormone analogue
  MOD_RES (2)..(2): Aib
  MOD_RES (38)..(38): The residue at this position is Lys modified with a Y2 group attached to its epsilon amino group

SEQ ID NO: 466 - protein, 40 aa, Artificial Sequence
  Component of peptide hormone analogue
  MOD_RES (2)..(2): Aib
  MOD_RES (40)..(40): The residue at this position is Lys modified with a Y2 group attached to its epsilon amino group
HXHGTFTSDYSKYLEEEAVRLFIEWLLQSHHQHHPSPPPK

SEQ ID NO: 467 - protein, 38 aa, Artificial Sequence
  Component of peptide hormone analogue
  MOD_RES (2)..(2): Aib
  MOD_RES (38)..(38): The residue at this position is Lys modified with a Y2 group attached to its epsilon amino group
HXHGTFTSDYSKYLDERRAQEFIEWLLQSHHQESPPPK

SEQ ID NO: 468 - protein, 37 aa, Artificial Sequence
  Component of peptide hormone analogue
  MOD_RES (2)..(2): Aib
  MOD_RES (37)..(37): The residue at this position is Lys modified with a Y2 group attached to its epsilon amino group
HXHGTFTSDYSKYLDERRAQEFIEWLLQSHHQSPPPK

SEQ ID NO: 469 - protein, 38 aa, Artificial Sequence
  Component of peptide hormone analogue
  MOD_RES (2)..(2): Aib
  MOD_RES (38)..(38): The residue at this position is Lys modified with a Y2 group attached to its epsilon amino group
HXHGTFTSDYSKYLDERRAHEFIEWLLQSHQHESPPPK

SEQ ID NO: 470 - protein, 40 aa, Artificial Sequence
  Component of peptide hormone analogue
  MOD_RES (2)..(2): Aib
  MOD_RES (40)..(40): The residue at this position is Lys modified with a Y2 group attached to its epsilon amino group
HXHGTFTSDYSRYLDERRAHEFIEWLLQSHHQHHPSPPPK

SEQ ID NO: 471 - protein, 38 aa, Artificial Sequence
  Component of peptide hormone analogue
  MOD_RES (2)..(2): Aib
  MOD_RES (38)..(38): The residue at this position is Lys modified with a Y2 group attached to its epsilon amino group
HXHGTFTSDYSRYLDERRAQEFIEWLLQSHQHESPPPK

SEQ ID NO: 472 - protein, 38 aa, Artificial Sequence
  Component of peptide hormone analogue
  MOD_RES (2)..(2): Aib
  MOD_RES (38)..(38): The residue at this position is Lys modified with a Y2 group attached to its epsilon amino group
HXHGTFTSDYSKYLDERRAQEFIEWLLQSHQHESPPPK

SEQ ID NO: 473 - protein, 38 aa, Artificial Sequence
  Component of peptide hormone analogue
  MOD_RES (2)..(2): Aib
  MOD_RES (38)..(38): The residue at this position is Lys modified with a Y2 group attached to its epsilon amino group
HXHGTFTSDYSRYLDERRAHEFIEWLLQSHQHPSPPPK

SEQ ID NO: 474 - protein, 40 aa, Artificial Sequence
  Component of peptide hormone analogue
  MOD_RES (2)..(2): Aib
  MOD_RES (40)..(40): The residue at this position is Lys modified with a Y2 group attached to its epsilon amino group
HXHGTFTSDYSRYLDERRAQEFIEWLLQSHQQQHPSPPPK

SEQ ID NO: 475 - protein, 40 aa, Artificial Sequence
  Component of peptide hormone analogue
  MOD_RES (2)..(2): Aib
  MOD_RES (40)..(40): The residue at this position is Lys modified with a Y2 group attached to its epsilon amino group
HXHGTFTSDYSKYLDERRAQEFIEWLLQSHQQQHESPPPK

SEQ ID NO: 476 - protein, 40 aa, Artificial Sequence; identical to SEQ ID NO: 475
  Component of peptide hormone analogue
  MOD_RES (2)..(2): Aib
  MOD_RES (40)..(40): The residue at this position is Lys modified with a Y2 group attached to its epsilon amino group

SEQ ID NO: 477 - protein, 37 aa, Artificial Sequence
  Component of peptide hormone analogue
  MOD_RES (2)..(2): Aib
  MOD_RES (37)..(37): The residue at this position is Lys modified with a Y2 group attached to its epsilon amino group
HXHGTFTSDYSRYLDERRAQEFIEWLLQSHEPSPPPK

SEQ ID NO: 478 - protein, 37 aa, Artificial Sequence
  Component of peptide hormone analogue
  MOD_RES (2)..(2): Aib
  MOD_RES (37)..(37): The residue at this position is Lys modified with a Y2 group attached to its epsilon amino group
HXHGTFTSDYSKYLDERRAQEFIEWLLQSHEESPPPK

SEQ ID NO: 479 - protein, 37 aa, Artificial Sequence; identical to SEQ ID NO: 478
  Component of peptide hormone analogue
  MOD_RES (2)..(2): Aib
  MOD_RES (37)..(37): The residue at this position is Lys modified with a Y2 group attached to its epsilon amino group

SEQ ID NO: 480 - protein, 38 aa, Artificial Sequence
  Component of peptide hormone analogue
  MOD_RES (2)..(2): Aib
  MOD_RES (38)..(38): The residue at this position is Lys modified with a Y2 group attached to its epsilon amino group
HXHGTFTSDYSKYLDERRAQEFIEWLLQSHQQESPPPK

SEQ ID NO: 481 - protein, 40 aa, Artificial Sequence
  Component of peptide hormone analogue
  MOD_RES (2)..(2): Aib
  MOD_RES (40)..(40): The residue at this position is Lys modified with a Y2 group attached to its epsilon amino group
HXHGTFTSDYSKYLDERRAQEFIEWLLQSQHQHQESPPPK

SEQ ID NO: 482 - protein, 40 aa, Artificial Sequence
  Component of peptide hormone analogue
  MOD_RES (2)..(2): Aib
  MOD_RES (40)..(40): The residue at this position is Lys modified with a Y2 group attached to its epsilon amino group
HXHGTFTSDYSKYLDERRAQEFIEWLLQSHQQHHESPPPK

SEQ ID NO: 483 - protein, 40 aa, Artificial Sequence
  Component of peptide hormone analogue
  MOD_RES (2)..(2): Aib
  MOD_RES (40)..(40): The residue at this position is Lys modified with a Y2 group attached to its epsilon amino group
HXHGTFTSDYSKYLDERRAQEFIEWLLQSHHQHQESPPPK

SEQ ID NO: 484 - protein, 40 aa, Artificial Sequence
  Component of peptide hormone analogue
  MOD_RES (2)..(2): Aib
  MOD_RES (40)..(40): The residue at this position is Lys modified with a Y2 group attached to its epsilon amino group
HXHGTFTSDYSKYLDERRAQEFIEWLLQSHHQQHESPPPK

SEQ ID NO: 485 - protein, 41 aa, Artificial Sequence
  Component of peptide hormone analogue
  MOD_RES (2)..(2): Aib
  MOD_RES (41)..(41): The residue at this position is Lys modified with a Y2 group attached to its epsilon amino group
HXHGTFTSDYSKYLDAKRAQEFIEWLLQSHQQQHESPPPGK

SEQ ID NO: 486 - protein, 39 aa, Artificial Sequence
  Component of peptide hormone analogue
  MOD_RES (2)..(2): Aib
  MOD_RES (39)..(39): The residue at this position is Lys modified with a Y2 group attached to its epsilon amino group
HXHGTFTSDYSKYLDAKRAQEFIEWLLQSHQHESPPPGK

SEQ ID NO: 487 - protein, 40 aa, Artificial Sequence
  Component of peptide hormone analogue
  MOD_RES (2)..(2): Aib
  MOD_RES (40)..(40): The residue at this position is Lys modified with a Y2 group attached to its epsilon amino group
HXHGTFTSDLSKQLEEEAVRLFIEWLKNGHHQHHPSPPPK

SEQ ID NO: 488 - protein, 40 aa, Artificial Sequence
  Component of peptide hormone analogue
  MOD_RES (2)..(2): Aib
  MOD_RES (40)..(40): The residue at this position is Lys modified with a Y2 group attached to its epsilon amino group
HXHGTFTSDYSKYLDAKRAQEFIEWLKQSHHQHHPSPPPK

SEQ ID NO: 489 - protein, 40 aa, Artificial Sequence
  Component of peptide hormone analogue
  MOD_RES (2)..(2): Aib
  MOD_RES (40)..(40): The residue at this position is Lys modified with a Y2 group attached to its epsilon amino group
HXHGTFTSDYSRYLDAKRAQEFIEWLKQSHHQHHPSPPPK

SEQ ID NO: 490 - protein, 37 aa, Artificial Sequence
  Component of peptide hormone analogue
  MOD_RES (2)..(2): Aib
  MOD_RES (37)..(37): The residue at this position is Lys modified with a Y2 group attached to its epsilon amino group
HXHGTFTSDYSRYLDAKRAQEFIEWLLQSHQESPPPK

SEQ ID NO: 491 - protein, 38 aa, Artificial Sequence
  Component of peptide hormone analogue
  MOD_RES (2)..(2): Aib
  MOD_RES (38)..(38): The residue at this position is Lys modified with a Y2 group attached to its epsilon amino group
HXHGTFTSDYSRYLDAKRAQEFIEWLLQSHQESPPPGK

SEQ ID NO: 492 - protein, 38 aa, Artificial Sequence
  Component of peptide hormone analogue
  MOD_RES (2)..(2): Aib
  MOD_RES (38)..(38): The residue at this position is Lys modified with a Y2 group attached to its epsilon amino group
HXHGTFTSDYSKYLDAKRAQEFIEWLLQSHQHPSPPPK

SEQ ID NO: 493 - protein, 38 aa, Artificial Sequence
  Component of peptide hormone analogue
  MOD_RES (2)..(2): Aib
  MOD_RES (38)..(38): The residue at this position is Lys modified with a Y2 group attached to its epsilon amino group
HXHGTFTSDYSKYLDAKRAQEFIEWLLQSHQQPSPPPK

SEQ ID NO: 494 - protein, 38 aa, Artificial Sequence
  Component of peptide hormone analogue
  MOD_RES (2)..(2): Aib
  MOD_RES (38)..(38): The residue at this position is Lys modified with a Y2 group attached to its epsilon amino group
HXHGTFTSDYSKYLDAKRAQEFIEWLLQSQQHPSPPPK

SEQ ID NO: 495 - protein, 38 aa, Artificial Sequence
  Component of peptide hormone analogue
  MOD_RES (2)..(2): Aib
  MOD_RES (38)..(38): The residue at this position is Lys modified with a Y2 group attached to its epsilon amino group
HXHGTFTSDYSKYLDAKRAQEFIEWLLQSQQHESPPPK

SEQ ID NO: 496 - protein, 38 aa, Artificial Sequence; identical to SEQ ID NO: 492
  Component of peptide hormone analogue
  MOD_RES (2)..(2): Aib
  MOD_RES (38)..(38): The residue at this position is Lys modified with a Y2 group attached to its epsilon amino group

SEQ ID NO: 497 - protein, 38 aa, Artificial Sequence; identical to SEQ ID NO: 492
  Component of peptide hormone analogue
  MOD_RES (2)..(2): Aib
  MOD_RES (38)..(38): The residue at this position is Lys modified with a Y2 group attached to its epsilon amino group

SEQ ID NO: 498 - protein, 38 aa, Artificial Sequence
  Component of peptide hormone analogue
  MOD_RES (2)..(2): Aib
  MOD_RES (38)..(38): The residue at this position is Lys modified with a Y2 group attached to its epsilon amino group
HXHGTFTSDYSRYLDAKRAQEFIEWLLQSHQHPSPPPK

SEQ ID NO: 499 - protein, 39 aa, Artificial Sequence
  Component of peptide hormone analogue
  MOD_RES (2)..(2): Aib
  MOD_RES (39)..(39): The residue at this position is Lys modified with a Y2 group attached to its epsilon amino group
HXHGTFTSDYSRYLDAKRAQEFIEWLLQSHQHPSPPPGK

SEQ ID NO: 500 - protein, 39 aa, Artificial Sequence
  Component of peptide hormone analogue
  MOD_RES (2)..(2): Aib
  MOD_RES (39)..(39): The residue at this position is Lys modified with a Y2 group attached to its epsilon amino group
HXHGTFTSDYSRYLDAKRAQEFIEWLLQSQQHPSPPPGK

SEQ ID NO: 501 - protein, 39 aa, Artificial Sequence
  Component of peptide hormone analogue
  MOD_RES (2)..(2): Aib
  MOD_RES (39)..(39): The residue at this position is Lys modified with a Y2 group attached to its epsilon amino group
HXHGTFTSDYSRYLDAKRAQEFIEWLLQSHQQPSPPPGK

SEQ ID NO: 502 - protein, 38 aa, Artificial Sequence; identical to SEQ ID NO: 492
  Component of peptide hormone analogue
  MOD_RES (2)..(2): Aib
  MOD_RES (38)..(38): The residue at this position is Lys modified with a Y2 group attached to its epsilon amino group

SEQ ID NO: 503 - protein, 37 aa, Artificial Sequence
  Component of peptide hormone analogue
  MOD_RES (2)..(2): Aib
  MOD_RES (37)..(37): The residue at this position is Lys modified with a Y2 group attached to its epsilon amino group
HXHGTFTSDYSKYLDAKRAQEFIEWLLQSHQQSPPPK

SEQ ID NO: 504 - protein, 37 aa, Artificial Sequence
  Component of peptide hormone analogue
  MOD_RES (2)..(2): Aib
  MOD_RES (37)..(37): The residue at this position is Lys modified with a Y2 group attached to its epsilon amino group
HXHGTFTSDYSKYLDAKRAQEFIEWLLHSHQQSPPPK

SEQ ID NO: 505 - protein, 38 aa, Artificial Sequence
  Component of peptide hormone analogue
  MOD_RES (2)..(2): Aib
  MOD_RES (38)..(38): The residue at this position is Lys modified with a Y2 group attached to its epsilon amino group
HXHGTFTSDYSKYLDAKRAQEFIEWLLQSHQQESPPPK

SEQ ID NO: 506 - protein, 38 aa, Artificial Sequence
  Component of peptide hormone analogue
  MOD_RES (2)..(2): Aib
  MOD_RES (38)..(38): The residue at this position is Lys modified with a Y2 group attached to its epsilon amino group
HXHGTFTSDYSKYLDAKRAQEFIEWLLQSHQQHSPPPK

SEQ ID NO: 507 - protein, 38 aa, Artificial Sequence
  Component of peptide hormone analogue
  MOD_RES (2)..(2): Aib
  MOD_RES (38)..(38): The residue at this position is Lys modified with a Y2 group attached to its epsilon amino group
HXHGTFTSDYSKYLDAKRAHEFIEWLLQSHQQHSPPPK

SEQ ID NO: 508 - protein, 39 aa, Artificial Sequence
  Component of peptide hormone analogue
  MOD_RES (2)..(2): Aib
  MOD_RES (39)..(39): The residue at this position is Lys modified with a Y2 group attached to its epsilon amino group
HXHGTFTSDYSKYLDAKRAQEFIEWLLQSHQHPSPPPGK

SEQ ID NO: 509 - protein, 38 aa, Artificial Sequence
  Component of peptide hormone analogue
  MOD_RES (2)..(2): Aib
  MOD_RES (38)..(38): The residue at this position is Lys modified with a Y2 group attached to its epsilon amino group
HXHGTFTSDYSRYLDERRAQEFIEWLLQSHQHPSPPPK

SEQ ID NO: 510 - protein, 38 aa, Artificial Sequence
  Component of peptide hormone analogue
  MOD_RES (2)..(2): Aib
  MOD_RES (38)..(38): The residue at this position is Lys modified with a Y2 group attached to its epsilon amino group
HXHGTFTSDYSKYLDQRRAHEFIEWLLHGHQHPSPPPK

SEQ ID NO: 511 - protein, 37 aa, Artificial Sequence
  Component of peptide hormone analogue
  MOD_RES (2)..(2): Aib
  MOD_RES (37)..(37): The residue at this position is Lys modified with a Y2 group attached to its epsilon amino group
HXHGTFTSDYSKYLDQRRAQDFIEWLLQSHQGAPPPK

SEQ ID NO: 512 - protein, 37 aa, Artificial Sequence
  Component of peptide hormone analogue
  MOD_RES (2)..(2): Aib
  MOD_RES (37)..(37): The residue at this position is Lys modified with a Y2 group attached to its epsilon amino group
HXHGTFTSDYSKYLDQRRAQDFIEWLLHSGHGAPPPK

SEQ ID NO: 513 - protein, 37 aa, Artificial Sequence
  Component of peptide hormone analogue
  MOD_RES (2)..(2): Aib
  MOD_RES (37)..(37): The residue at this position is Lys modified with a Y2 group attached to its epsilon amino group
HXHGTFTSDYSKYLDQRRAHDFIEWLLHSGHGAPPPK

SEQ ID NO: 514 - protein, 40 aa, Artificial Sequence
  Component of peptide hormone analogue
  MOD_RES (2)..(2): Aib
  MOD_RES (40)..(40): The residue at this position is Lys modified with a Y2 group attached to its epsilon amino group
HXHGTFTSDYSKYLDEKRAHEFIEWLLHGHGQGAPSPPPK

SEQ ID NO: 515 - protein, 39 aa, Artificial Sequence; identical to SEQ ID NO: 486
  Component of peptide hormone analogue
  MOD_RES (2)..(2): Aib
  MOD_RES (39)..(39): The residue at this position is Lys modified with a Y2 group attached to its epsilon amino group

SEQ ID NO: 516 - protein, 40 aa, Artificial Sequence
  Component of peptide hormone analogue
  MOD_RES (2)..(2): Aib
  MOD_RES (40)..(40): The residue at this position is Lys modified with a Y2 group attached to its epsilon amino group
HXHGTFTSDYSKYLDAKRAQEFIEWLLQSHQQHESPPPGK

SEQ ID NO: 517 - protein, 38 aa, Artificial Sequence; identical to SEQ ID NO: 493
  Component of peptide hormone analogue
  MOD_RES (2)..(2): Aib
  MOD_RES (38)..(38): The residue at this position is Lys modified with a Y2 group attached to its epsilon amino group

SEQ ID NO: 518 - protein, 39 aa, Artificial Sequence
  Component of peptide hormone analogue
  MOD_RES (2)..(2): Aib
  MOD_RES (39)..(39): The residue at this position is Lys modified with a Y2 group attached to its epsilon amino group
HXHGTFTSDYSKYLDAKRAQEFIEWLLQSHPSSGAPPPK

SEQ ID NO: 519 - protein, 39 aa, Artificial Sequence; identical to SEQ ID NO: 499
  Component of peptide hormone analogue
  MOD_RES (2)..(2): Aib
  MOD_RES (39)..(39): The residue at this position is Lys modified with a Y2 group attached to its epsilon amino group

SEQ ID NO: 520 - protein, 39 aa, Artificial Sequence; identical to SEQ ID NO: 508
  Component of peptide hormone analogue
  MOD_RES (2)..(2): Aib
  MOD_RES (39)..(39): The residue at this position is Lys modified with a Y2 group attached to its epsilon amino group

SEQ ID NO: 521 - protein, 38 aa, Artificial Sequence; identical to SEQ ID NO: 492
  Component of peptide hormone analogue
  MOD_RES (2)..(2): Aib
  MOD_RES (38)..(38): The residue at this position is Lys modified with a Y2 group attached to its epsilon amino group

SEQ ID NO: 522 - protein, 40 aa, Artificial Sequence
  Component of peptide hormone analogue
  MOD_RES (2)..(2): Aib
  MOD_RES (40)..(40): The residue at this position is Lys modified with a Y2 group attached to its epsilon amino group
HXHGTFTSDYSKYLDAKRAQEFIEWLLQSQHQHQESPPPK

SEQ ID NO: 523 - protein, 40 aa, Artificial Sequence
  Component of peptide hormone analogue
  MOD_RES (2)..(2): Aib
  MOD_RES (40)..(40): The residue at this position is Lys modified with a Y2 group attached to its epsilon amino group
HXHGTFTSDYSKYLDAKRAQEFIEWLLQSQHQHQPSPPPK

SEQ ID NO: 524 - protein, 39 aa, Artificial Sequence
  Component of peptide hormone analogue
  MOD_RES (2)..(2): Aib
  MOD_RES (39)..(39): The residue at this position is Lys modified with a Y2 group attached to its epsilon amino group
HXHGTFTSDYSKYLDERRAQEFIEWLLQSQHQHPSPPPK

SEQ ID NO: 525 - protein, 40 aa, Artificial Sequence
  Component of peptide hormone analogue
  MOD_RES (2)..(2): Aib
  MOD_RES (40)..(40): The residue at this position is Lys modified with a Y2 group attached to its epsilon amino group
HXHGTFTSDYSKYLDAKRAQEFIEWLLQSHHQQHPSPPPK

SEQ ID NO: 526 - protein, 40 aa, Artificial Sequence
  Component of peptide hormone analogue
  MOD_RES (2)..(2): Aib
  MOD_RES (40)..(40): The residue at this position is Lys modified with a Y2 group attached to its epsilon amino group
HXHGTFTSDYSKYLDERRAQEFIEWLLQSHHQQHPSPPPK

SEQ ID NO: 527 - protein, 39 aa, Artificial Sequence
  Component of peptide hormone analogue
  MOD_RES (2)..(2): Aib
  MOD_RES (39)..(39): The residue at this position is Lys modified with a Y2 group attached to its epsilon amino group
HXHGTFTSDLSKQLEEKRAQEFIEWLLNGHPSSGAPPPK

SEQ ID NO: 528 - protein, 39 aa, Artificial Sequence
  Component of peptide hormone analogue
  MOD_RES (2)..(2): Aib
  MOD_RES (39)..(39): The residue at this position is Lys modified with a Y2 group attached to its epsilon amino group
HXHGTFTSDLSKQLEEKRAHEFIEWLLHGHPSSGAPPPK

SEQ ID NO: 529 - protein, 39 aa, Artificial Sequence
  Component of peptide hormone analogue
  MOD_RES (2)..(2): Aib
  MOD_RES (39)..(39): The residue at this position is Lys modified with a Y2 group attached to its epsilon amino group
HXHGTFTSDLSKQLEAKRAHEFIEWLLHGHPSSGAPPPK

SEQ ID NO: 530 - protein, 39 aa, Artificial Sequence; identical to SEQ ID NO: 529
  Component of peptide hormone analogue
  MOD_RES (2)..(2): Aib
  MOD_RES (39)..(39): The residue at this position is Lys modified with a Y2 group attached to its epsilon amino group

SEQ ID NO: 531 - protein, 39 aa, Artificial Sequence
  Component of peptide hormone analogue
  MOD_RES (2)..(2): Aib
  MOD_RES (39)..(39): The residue at this position is Lys modified with a Y2 group attached to its epsilon amino group
HXHGTFTSDLSKQLEEEAVRLFIEWLLQSHPSSGAPPPK

SEQ ID NO: 532 - protein, 40 aa, Artificial Sequence
  Component of peptide hormone analogue
  MOD_RES (2)..(2): Aib
  MOD_RES (40)..(40): The residue at this position is Lys modified with a Y2 group attached to its epsilon amino group
HXHGTFTSDYSKYLDAKRAQEFIEWLLQSHQQHHPSPPPK

SEQ ID NO: 533 - protein, 40 aa, Artificial Sequence
  Component of peptide hormone analogue
  MOD_RES (2)..(2): Aib
  MOD_RES (40)..(40): The residue at this position is Lys modified with a Y2 group attached to its epsilon amino group
HXHGTFTSDYSKYLDAKRAQEFIEWLLQSQHQHHPSPPPK

SEQ ID NO: 534 - protein, 40 aa, Artificial Sequence
  Component of peptide hormone analogue
  MOD_RES (2)..(2): Aib
  MOD_RES (40)..(40): The residue at this position is Lys modified with a Y2 group attached to its epsilon amino group
HXHGTFTSDYSKYLDAKRAQEFIEWLLQSHQQQHPSPPPK

SEQ ID NO: 535 - protein, 40 aa, Artificial Sequence
  Component of peptide hormone analogue
  MOD_RES (2)..(2): Aib
  MOD_RES (40)..(40): The residue at this position is Lys modified with a Y2 group attached to its epsilon amino group
HXHGTFTSDYSKYLDAKRAQEFIEWLLQSHQHQHPSPPPK

SEQ ID NO: 536 - protein, 40 aa, Artificial Sequence; identical to SEQ ID NO: 317
  Component of peptide hormone analogue
  MOD_RES (2)..(2): Aib
  MOD_RES (40)..(40): The residue at this position is Lys modified with a Y2 group attached to its epsilon amino group

SEQ ID NO: 537 - protein, 40 aa, Artificial Sequence; identical to SEQ ID NO: 317
  Component of peptide hormone analogue
  MOD_RES (2)..(2): Aib
  MOD_RES (40)..(40): The residue at this position is Lys modified with a Y2 group attached to its epsilon amino group

SEQ ID NO: 538 - protein, 41 aa, Artificial Sequence; identical to SEQ ID NO: 262
  Component of peptide hormone analogue
  MOD_RES (2)..(2): Aib
  MOD_RES (41)..(41): The residue at this position is Lys modified with a Y2 group attached to its epsilon amino group

SEQ ID NO: 539 - protein, 40 aa, Artificial Sequence
  Component of peptide hormone analogue
  MOD_RES (2)..(2): Aib
  MOD_RES (40)..(40): The residue at this position is Lys modified with a Y2 group attached to its epsilon amino group
HXHGTFTSDLSKQLEEERVREFIEWLKNGGPHSGAPPPGK

SEQ ID NO: 540 - protein, 40 aa, Artificial Sequence
  Component of peptide hormone analogue
  MOD_RES (2)..(2): Aib
  MOD_RES (40)..(40): The residue at this position is Lys modified with a Y2 group attached to its epsilon amino group
HXHGTFTSDLSKQLEEERVREFIEWLKNGHPHSGAPPPGK

SEQ ID NO: 541 - protein, 40 aa, Artificial Sequence
  Component of peptide hormone analogue
  MOD_RES (2)..(2): Aib
  MOD_RES (40)..(40): The residue at this position is Lys modified with a Y2 group attached to its epsilon amino group
HXHGTFTSDLSKQLEEERVREFIEWLKNGGPHHGAPPPGK

SEQ ID NO: 542 - protein, 38 aa, Artificial Sequence; identical to SEQ ID NO: 495
  Component of peptide hormone analogue
  MOD_RES (2)..(2): Aib
  MOD_RES (38)..(38): The residue at this position is Lys modified with a Y2 group attached to its epsilon amino group

SEQ ID NO: 543 - protein, 38 aa, Artificial Sequence; identical to SEQ ID NO: 495
  Component of peptide hormone analogue
  MOD_RES (2)..(2): Aib
  MOD_RES (38)..(38): The residue at this position is Lys modified with a Y2 group attached to its epsilon amino group

SEQ ID NO: 544 - protein, 38 aa, Artificial Sequence; identical to SEQ ID NO: 492
  Component of peptide hormone analogue
  MOD_RES (2)..(2): Aib
  MOD_RES (38)..(38): The residue at this position is Lys modified with a Y2 group attached to its epsilon amino group

SEQ ID NO: 545 - protein, 38 aa, Artificial Sequence; identical to SEQ ID NO: 491
  Component of peptide hormone analogue
  MOD_RES (2)..(2): Aib
  MOD_RES (38)..(38): The residue at this position is Lys modified with a Y2 group attached to its epsilon amino group

SEQ ID NO: 546 - protein, 39 aa, Artificial Sequence
  Component of peptide hormone analogue
  MOD_RES (2)..(2): Aib
  MOD_RES (39)..(39): The residue at this position is Lys modified with a Y2 group attached to its epsilon amino group
HXHGTFTSDYSRYLDARRAQEFIEWLLQSHQHESPPPGK

SEQ ID NO: 547 - protein, 39 aa, Artificial Sequence
  Component of peptide hormone analogue
  MOD_RES (2)..(2): Aib
  MOD_RES (39)..(39): The residue at this position is Lys modified with a Y2 group attached to its epsilon amino group
HXHGTFTSDYSKYLDAKRAQEFIEWLLHSQQHESPPPGK

SEQ ID NO: 548 - protein, 41 aa, Artificial Sequence
  Component of peptide hormone analogue
  MOD_RES (2)..(2): Aib
  MOD_RES (41)..(41): The residue at this position is Lys modified with a Y2 group attached to its epsilon amino group
HXHGTFTSDYSRYLDAKRAQEFIEWLLQSHHQQQPSPPPGK

SEQ ID NO: 549 - protein, 40 aa, Artificial Sequence
  Component of peptide hormone analogue
  MOD_RES (2)..(2): Aib
  MOD_RES (40)..(40): The residue at this position is Lys modified with a Y2 group attached to its epsilon amino group
HXHGTFTSDYSKYLDAKRAQEFIEWLLQSHHQQHESPPPK

SEQ ID NO: 550 - protein, 40 aa, Artificial Sequence; identical to SEQ ID NO: 525
  Component of peptide hormone analogue
  MOD_RES (2)..(2): Aib
  MOD_RES (40)..(40): The residue at this position is Lys modified with a Y2 group attached to its epsilon amino group

SEQ ID NO: 551 - protein, 39 aa, Artificial Sequence; identical to SEQ ID NO: 508
  Component of peptide hormone analogue
  MOD_RES (2)..(2): Aib
  MOD_RES (39)..(39): The residue at this position is Lys modified with a Y2 group attached to its epsilon amino group

SEQ ID NO: 552 - protein, 40 aa, Artificial Sequence; identical to SEQ ID NO: 535
  Component of peptide hormone analogue
  MOD_RES (2)..(2): Aib
  MOD_RES (40)..(40): The residue at this position is Lys modified with a Y2 group attached to its epsilon amino group

SEQ ID NO: 553 - protein, 41 aa, Artificial Sequence
  Component of peptide hormone analogue
  MOD_RES (2)..(2): Aib
  MOD_RES (41)..(41): The residue at this position is Lys modified with a Y2 group attached to its epsilon amino group
HXHGTFTSDYSKYLDAKRAQEFIEWLLQSHQQQHPSPPPGK

SEQ ID NO: 554 - protein, 40 aa, Artificial Sequence
  Component of peptide hormone analogue
  MOD_RES (2)..(2): Aib
  MOD_RES (40)..(40): The residue at this position is Lys modified with a Y2 group attached to its epsilon amino group
HXHGTFTSDLSKQLEEERVRLFIEWLKHGHPSSGAPPPGK

SEQ ID NO: 555 - protein, 40 aa, Artificial Sequence
  Component of peptide hormone analogue
  MOD_RES (2)..(2): Aib
  MOD_RES (40)..(40): The residue at this position is Lys modified with a Y2 group attached to its epsilon amino group
HXHGTFTSDLSKQLEEERVRLFIEWLKHGGPHSGAPPPGK

SEQ ID NO: 556 - protein, 40 aa, Artificial Sequence
  Component of peptide hormone analogue
  MOD_RES (2)..(2): Aib
  MOD_RES (40)..(40): The residue at this position is Lys modified with a Y2 group attached to its epsilon amino group
HXHGTFTSDLSKQLEEERVRLFIEWLKHGGPSHGAPPPGK

SEQ ID NO: 557 - protein, 40 aa, Artificial Sequence
  Component of peptide hormone analogue
  MOD_RES (2)..(2): Aib
  MOD_RES (40)..(40): The residue at this position is Lys modified with a Y2 group attached to its epsilon amino group
HXHGTFTSDLSKQLEEERVRLFIEWLKNGGPSHGHPPPGK

SEQ ID NO: 558 - protein, 40 aa, Artificial Sequence
  Component of peptide hormone analogue
  MOD_RES (2)..(2): Aib
  MOD_RES (40)..(40): The residue at this position is Lys modified with a Y2 group attached to its epsilon amino group
HXHGTFTSDLSKQLEEERVRLFIEWLKNGGPSHGAPPPGK

SEQ ID NO: 559 - protein, 40 aa, Artificial Sequence
  Component of peptide hormone analogue
  MOD_RES (2)..(2): Aib
  MOD_RES (40)..(40): The residue at this position is Lys modified with a Y2 group attached to its epsilon amino group
HXHGTFTSDLSKQLEEERVRLFIEWLKNGGPHSGAPPPGK

SEQ ID NO: 560 - protein, 40 aa, Artificial Sequence
  Component of peptide hormone analogue
  MOD_RES (2)..(2): Aib
  MOD_RES (40)..(40): The residue at this position is Lys modified with a Y2 group attached to its epsilon amino group
HXHGTFTSDLSKQLEEERVRLFIEWLKNGGHSSGAPPPGK

SEQ ID NO: 561 - protein, 40 aa, Artificial Sequence
  Component of peptide hormone analogue
  MOD_RES (2)..(2): Aib
  MOD_RES (40)..(40): The residue at this position is Lys modified with a Y2 group attached to its epsilon amino group
HXHGTFTSDLSKQLEEERVRLFIEWLKNGHPSSGAPPPGK

SEQ ID NO: 562 - protein, 40 aa, Artificial Sequence
  Component of peptide hormone analogue
  MOD_RES (2)..(2): Aib
  MOD_RES (40)..(40): The residue at this position is Lys modified with a Y2 group attached to its epsilon amino group
HXHGTFTSDLSKQLEEERVRLFIEWLKNGHPHSGAPPPGK

SEQ ID NO: 563 - protein, 40 aa, Artificial Sequence
  Component of peptide hormone analogue
  MOD_RES (2)..(2): Aib
  MOD_RES (40)..(40): The residue at this position is Lys modified with a Y2 group attached to its epsilon amino group
HXHGTFTSDLSKQLEEERVRLFIEWLKNGHQHSGAPPPGK

SEQ ID NO: 564 - protein, 40 aa, Artificial Sequence; identical to SEQ ID NO: 559
  Component of peptide hormone analogue
  MOD_RES (2)..(2): Aib
  MOD_RES (40)..(40): The residue at this position is Lys modified with a Y2 group attached to its epsilon amino group

SEQ ID NO: 565 - protein, 40 aa, Artificial Sequence; identical to SEQ ID NO: 560
  Component of peptide hormone analogue
  MOD_RES (2)..(2): Aib
  MOD_RES (40)..(40): The residue at this position is Lys modified with a Y2 group attached to its epsilon amino group

SEQ ID NO: 566 - protein, 40 aa, Artificial Sequence; identical to SEQ ID NO: 561
  Component of peptide hormone analogue
  MOD_RES (2)..(2): Aib
  MOD_RES (40)..(40): The residue at this position is Lys modified with a Y2 group attached to its epsilon amino group

SEQ ID NO: 567 - protein, 40 aa, Artificial Sequence; identical to SEQ ID NO: 559
  Component of peptide hormone analogue
  MOD_RES (2)..(2): Aib
  MOD_RES (40)..(40): The residue at this position is Lys modified with a Y2 group attached to its epsilon amino group

SEQ ID NO: 568 - protein, 40 aa, Artificial Sequence; identical to SEQ ID NO: 560
  Component of peptide hormone analogue
  MOD_RES (2)..(2): Aib
  MOD_RES (40)..(40): The residue at this position is Lys modified with a Y2 group attached to its epsilon amino group

SEQ ID NO: 569 - protein, 40 aa, Artificial Sequence; identical to SEQ ID NO: 561
  Component of peptide hormone analogue
  MOD_RES (2)..(2): Aib
  MOD_RES (40)..(40): The residue at this position is Lys modified with a Y2 group attached to its epsilon amino group

SEQ ID NO: 570 - protein, 40 aa, Artificial Sequence
  Component of peptide hormone analogue
  MOD_RES (2)..(2): Aib
  MOD_RES (40)..(40): The residue at this position is Lys modified with a Y2 group attached to its epsilon amino group
HXHGTFTSDLSKQLEEERVHLFIEWLKNGGHSSGAPPPGK

SEQ ID NO: 571 - protein, 40 aa, Artificial Sequence
  Component of peptide hormone analogue
  MOD_RES (2)..(2): Aib
  MOD_RES (40)..(40): The residue at this position is Lys modified with a Y2 group attached to its epsilon amino group
HXHGTFTSDLSKQLEEERVHLFIEWLKNGHPSSGAPPPGK

SEQ ID NO: 572 - protein, 39 aa, Artificial Sequence
  Component of peptide hormone analogue
  MOD_RES (2)..(2): Aib
  MOD_RES (39)..(39): The residue at this position is Lys modified with a Y2 group attached to its epsilon amino group
HXHGTFTSDLSKQLEQEAVRLFIEWLKNGHPSSGAPPPK

SEQ ID NO: 573 - protein, 39 aa, Artificial Sequence
  Component of peptide hormone analogue
  MOD_RES (2)..(2): Aib
  MOD_RES (39)..(39): The residue at this position is Lys modified with a Y2 group attached to its epsilon amino group
HXHGTFTSDLSKQLEQEAVRLFIEWLKNGGPHSGAPPPK

SEQ ID NO: 574 - protein, 39 aa, Artificial Sequence
  Component of peptide hormone analogue
  MOD_RES (2)..(2): Aib
  MOD_RES (39)..(39): The residue at this position is Lys modified with a Y2 group attached to its epsilon amino group
HXHGTFTSDLSKQLEQEAVRLFIEWLKNGGHSSGAPPPK

SEQ ID NO: 575 - protein, 39 aa, Artificial Sequence; identical to SEQ ID NO: 572
  Component of peptide hormone analogue
  MOD_RES (2)..(2): Aib
  MOD_RES (39)..(39): The residue at this position is Lys modified with a Y2 group attached to its epsilon amino group

SEQ ID NO: 576 - protein, 39 aa, Artificial Sequence; identical to SEQ ID NO: 573
  Component of peptide hormone analogue
  MOD_RES (2)..(2): Aib
  MOD_RES (39)..(39): The residue at this position is Lys modified with a Y2 group attached to its epsilon amino group

SEQ ID NO: 577 - protein, 39 aa, Artificial Sequence; identical to SEQ ID NO: 574
  Component of peptide hormone analogue
  MOD_RES (2)..(2): Aib
  MOD_RES (39)..(39): The residue at this position is Lys modified with a Y2 group attached to its epsilon amino group

SEQ ID NO: 578 - protein, 39 aa, Artificial Sequence; identical to SEQ ID NO: 572
  Component of peptide hormone analogue
  MOD_RES (2)..(2): Aib
  MOD_RES (39)..(39): The residue at this position is Lys modified with a Y2 group attached to its epsilon amino group

SEQ ID NO: 579 - protein, 39 aa, Artificial Sequence; identical to SEQ ID NO: 573
  Component of peptide hormone analogue
  MOD_RES (2)..(2): Aib
  MOD_RES (39)..(39): The residue at this position is Lys modified with a Y2 group attached to its epsilon amino group

SEQ ID NO: 580 - protein, 39 aa, Artificial Sequence; identical to SEQ ID NO: 574
  Component of peptide hormone analogue
  MOD_RES (2)..(2): Aib
  MOD_RES (39)..(39): The residue at this position is Lys modified with a Y2 group attached to its epsilon amino group

SEQ ID NO: 581 - protein, 38 aa, Artificial Sequence; identical to SEQ ID NO: 493
  Component of peptide hormone analogue
  MOD_RES (2)..(2): Aib
  MOD_RES (38)..(38): The residue at this position is Lys modified with a Y2 group attached to its epsilon amino group

SEQ ID NO: 582 - protein, 38 aa, Artificial Sequence
  Component of peptide hormone analogue
  MOD_RES (2)..(2): Aib
  MOD_RES (38)..(38): The residue at this position is Lys modified with a Y2 group attached to its epsilon amino group
HXHGTFTSDYSKYLDAKRAQEFIEWLLQSHHESPPPGK

SEQ ID NO: 583 - protein, 38 aa, Artificial Sequence; identical to SEQ ID NO: 491
  Component of peptide hormone analogue
  MOD_RES (2)..(2): Aib
  MOD_RES (38)..(38): The residue at this position is Lys modified with a Y2 group attached to its epsilon amino group

SEQ ID NO: 584 - protein, 38 aa, Artificial Sequence; identical to SEQ ID NO: 495
  Component of peptide hormone analogue
  MOD_RES (2)..(2): Aib
  MOD_RES (38)..(38): The residue at this position is Lys modified with a Y2 group attached to its epsilon amino group

SEQ ID NO: 585 - protein, 39 aa, Artificial Sequence
  Component of peptide hormone analogue
  MOD_RES (2)..(2): Aib
  MOD_RES (39)..(39): The residue at this position is Lys modified with a Y2 group attached to its epsilon amino group
HXHGTFTSDLSKQLEEEAVRLFIEWLKNGHHSSGAPPPK

SEQ ID NO: 586 - protein, 39 aa, Artificial Sequence; identical to SEQ ID NO: 585
  Component of peptide hormone analogue
  MOD_RES (2)..(2): Aib
  MOD_RES (39)..(39): The residue at this position is Lys modified with a Y2 group attached to its epsilon amino group

SEQ ID NO: 587 - protein, 39 aa, Artificial Sequence
  Component of peptide hormone analogue
  MOD_RES (2)..(2): Aib
  MOD_RES (39)..(39): The residue at this position is Lys modified with a Y2 group attached to its epsilon amino group
HXHGTFTSDYSKYLDAKRAHEFIEWLLQSHQQHESPPPK

SEQ ID NO: 588 - protein, 39 aa, Artificial Sequence; identical to SEQ ID NO: 587
  Component of peptide hormone analogue
  MOD_RES (2)..(2): Aib
  MOD_RES (39)..(39): The residue at this position is Lys modified with a Y2 group attached to its epsilon amino group

SEQ ID NO: 589 - protein, 38 aa, Artificial Sequence; identical to SEQ ID NO: 507
  Component of peptide hormone analogue
  MOD_RES (2)..(2): Aib
  MOD_RES (38)..(38): The residue at this position is Lys modified with a Y2 group attached to its epsilon amino group

SEQ ID NO: 590 - protein, 38 aa, Artificial Sequence; identical to SEQ ID NO: 507
  Component of peptide hormone analogue
  MOD_RES (2)..(2): Aib
  MOD_RES (38)..(38): The residue at this position is Lys modified with a Y2 group attached to its epsilon amino group

SEQ ID NO: 591 - protein, 38 aa, Artificial Sequence; identical to SEQ ID NO: 507
  Component of peptide hormone analogue
  MOD_RES (2)..(2): Aib
  MOD_RES (38)..(38): The residue at this position is Lys modified with a Y2 group attached to its epsilon amino group

SEQ ID NO: 592 - protein, 38 aa, Artificial Sequence; identical to SEQ ID NO: 507
  Component of peptide hormone analogue
  MOD_RES (2)..(2): Aib
  MOD_RES (38)..(38): The residue at this position is Lys modified with a Y2 group attached to its epsilon amino group

SEQ ID NO: 593 - protein, 38 aa, Artificial Sequence; identical to SEQ ID NO: 507
  Component of peptide hormone analogue
  MOD_RES (2)..(2): Aib
  MOD_RES (38)..(38): The residue at this position is Lys modified with a Y2 group attached to its epsilon amino group

SEQ ID NO: 594 - protein, 38 aa, Artificial Sequence
  Component of peptide hormone analogue
  MOD_RES (2)..(2): Aib
  MOD_RES (38)..(38): The residue at this position is Lys modified with a Y2 group attached to its epsilon amino group
HXHGTFTSDYSKYLDAKRAQEFIEWLLQSHQHESPPPK

SEQ ID NO: 595 - protein, 38 aa, Artificial Sequence; identical to SEQ ID NO: 594
  Component of peptide hormone analogue
  MOD_RES (2)..(2): Aib
  MOD_RES (38)..(38): The residue at this position is Lys modified with a Y2 group attached to its epsilon amino group

SEQ ID NO: 596 - protein, 39 aa, Artificial Sequence
  Component of peptide hormone analogue
  MOD_RES (2)..(2): Aib
  MOD_RES (39)..(39): The residue at this position is Lys modified with a Y2 group attached to its epsilon amino group
HXHGTFTSDLSKQLEQEAVRLFIEWLKNGHQQHGAPPPK

SEQ ID NO: 597 - protein, 38 aa, Artificial Sequence; identical to SEQ ID NO: 594
  Component of peptide hormone analogue
  MOD_RES (2)..(2): Aib
  MOD_RES (38)..(38): The residue at this position is Lys modified with a Y2 group attached to its epsilon amino group

SEQ ID NO: 598 - protein, 39 aa, Artificial Sequence
  Component of peptide hormone analogue
  MOD_RES (2)..(2): Aib
  MOD_RES (39)..(39): The residue at this position is Lys modified with a Y2 group attached to its epsilon amino group
HXHGTFTSDYSKYLDAKRAQEFIEWLLQSHQQHESPPPK

SEQ ID NO: 599 - protein, 41 aa, Artificial Sequence
  Component of peptide hormone analogue
  MOD_RES (2)..(2): Aib
  MOD_RES (41)..(41): The residue at this position is Lys modified with a Y2 group attached to its epsilon amino group
HXHGTFTSDYSKYLDAKRAQEFIEWLLQSHQQHESGAPPPK

SEQ ID NO: 600 - protein, 41 aa, Artificial Sequence
  Component of peptide hormone analogue
  MOD_RES (2)..(2): Aib
  MOD_RES (41)..(41): The residue at this position is Lys modified with a Y2 group attached to its epsilon amino group
HXHGTFTSDYSKYLDAKRAHEFIEWLLQSHQQHESGAPPPK

SEQ ID NO: 601 - protein, 41 aa, Artificial Sequence; identical to SEQ ID NO: 600
  Component of peptide hormone analogue
  MOD_RES (2)..(2): Aib
  MOD_RES (41)..(41): The residue at this position is Lys modified with a Y2 group attached to its epsilon amino group

SEQ ID NO: 602 - protein, 40 aa, Artificial Sequence
  Component of peptide hormone analogue
  MOD_RES (2)..(2): Aib
  MOD_RES (40)..(40): The residue at this position is Lys modified with a Y2 group attached to its epsilon amino group
HXHGTFTSDYSKYLDAKRAQEFIEWLLQSHQQQHESPPPK

SEQ ID NO: 603 - protein, 40 aa, Artificial Sequence
  Component of peptide hormone analogue
  MOD_RES (2)..(2): Aib
  MOD_RES (40)..(40): The residue at this position is Lys modified with a Y2 group attached to its epsilon amino group
HXHGTFTSDYSKYLDAKRAQEFIEWLLQSHQQHHESPPPK

SEQ ID NO: 604 - protein, 39 aa, Artificial Sequence
  Component of peptide hormone analogue
  MOD_RES (2)..(2): Aib
  MOD_RES (39)..(39): The residue at this position is Lys modified with a Y2 group attached to its epsilon amino group
HXHGTFTSDYSKYLDAKRAQEFIEWLLQSHHQHESPPPK

SEQ ID NO: 605 - protein, 40 aa, Artificial Sequence
  Component of peptide hormone analogue
  MOD_RES (2)..(2): Aib
  MOD_RES (40)..(40): The residue at this position is Lys modified with a Y2 group attached to its epsilon amino group
HXHGTFTSDYSKYLDAKRAHEFIEWLLQSHHQHHESPPPK

SEQ ID NO: 606 - protein, 38 aa, Artificial Sequence
  Component of peptide hormone analogue
  MOD_RES (2)..(2): Aib
  MOD_RES (38)..(38): The residue at this position is Lys modified with a Y2 group attached to its epsilon amino group
HXHGTFTSDYSKYLDAKRAHEFIEWLLQSHQHESPPPK

SEQ ID NO: 607 - protein, 39 aa, Artificial Sequence
  Component of peptide hormone analogue
  MOD_RES (2)..(2): Aib
  MOD_RES (39)..(39): The residue at this position is Lys modified with a Y2 group attached to its epsilon amino group
HXHGTFTSDLSKQLEEERVRLFIEWLKNGGPSHGAPPPK

SEQ ID NO: 608 - protein, 39 aa, Artificial Sequence
  Component of peptide hormone analogue
  MOD_RES (2)..(2): Aib
  MOD_RES (39)..(39): The residue at this position is Lys modified with a Y2 group attached to its epsilon amino group
HXHGTFTSDLSKQLEEERVRLFIEWLKNGGPSHGHPPPK

SEQ ID NO: 609 - protein, 39 aa, Artificial Sequence
  Component of peptide hormone analogue
  MOD_RES (2)..(2): Aib
  MOD_RES (39)..(39): The residue at this position is Lys modified with a Y2 group attached to its epsilon amino group
HXHGTFTSDLSKQLEEEAVREFIEWLKNGGPSHGHPPPK

SEQ ID NO: 610 - protein, 39 aa, Artificial Sequence; identical to SEQ ID NO: 608
  Component of peptide hormone analogue
  MOD_RES (2)..(2): Aib
  MOD_RES (39)..(39): The residue at this position is Lys modified with a Y2 group attached to its epsilon amino group

SEQ ID NO: 611 - protein, 39 aa, Artificial Sequence
  Component of peptide hormone analogue
  MOD_RES (2)..(2): Aib
  MOD_RES (39)..(39): The residue at this position is Lys modified with a Y2 group attached to its epsilon amino group
HXHGTFTSDLSKQLEEERVREFIEWLKNGGPSHGHPPPK

SEQ ID NO: 612 - protein, 39 aa, Artificial Sequence
  Component of peptide hormone analogue
  MOD_RES (2)..(2): Aib
  MOD_RES (39)..(39): The residue at this position is Lys modified with a Y2 group attached to its epsilon amino group
HXHGTFTSDLSKQLEQERVRLFIEWLKNGGPSHGHPPPK

SEQ ID NO: 613 - protein, 39 aa, Artificial Sequence; identical to SEQ ID NO: 612
  Component of peptide hormone analogue
  MOD_RES (2)..(2): Aib
  MOD_RES (39)..(39): The residue at this position is Lys modified with a Y2 group attached to its epsilon amino group

SEQ ID NO: 614 - protein, 39 aa, Artificial Sequence; identical to SEQ ID NO: 612
  Component of peptide hormone analogue
  MOD_RES (2)..(2): Aib
  MOD_RES (39)..(39): The residue at this position is Lys modified with a Y2 group attached to its epsilon amino group

SEQ ID NO: 615 - protein, 39 aa, Artificial Sequence; identical to SEQ ID NO: 608
  Component of peptide hormone analogue
  MOD_RES (2)..(2): Aib
  MOD_RES (39)..(39): The residue at this position is Lys modified with a Y2 group attached to its epsilon amino group

SEQ ID NO: 616 - protein, 39 aa, Artificial Sequence
  Component of peptide hormone analogue
  MOD_RES (2)..(2): Aib
  MOD_RES (39)..(39): The residue at this position is Lys modified with a Y2 group attached to its epsilon amino group
HXHGTFTSDLSKQLEQEAVRLFIEWLKNGGPSHGHPPPK

SEQ ID NO: 617 - protein, 39 aa, Artificial Sequence
  Component of peptide hormone analogue
  MOD_RES (2)..(2): Aib
  MOD_RES (39)..(39): The residue at this position is Lys modified with a Y2 group attached to its epsilon amino group
HXHGTFTSDLSKQLEEEAVRLFIEWLKNGGPSHGHPPPK

SEQ ID NO: 618 - protein, 39 aa, Artificial Sequence
  Component of peptide hormone analogue
  MOD_RES (2)..(2): Aib
  MOD_RES (39)..(39): The residue at this position is Lys modified with a Y2 group attached to its epsilon amino group
HXHGTFTSDLSKQLEQEAVREFIEWLKNGGPSHGHPPPK

SEQ ID NO: 619 - protein, 39 aa, Artificial Sequence; identical to SEQ ID NO: 616
  Component of peptide hormone analogue
  MOD_RES (2)..(2): Aib
  MOD_RES (39)..(39): The residue at this position is Lys modified with a Y2 group attached to its epsilon amino group

SEQ ID NO: 620 - protein, 39 aa, Artificial Sequence; identical to SEQ ID NO: 617
  Component of peptide hormone analogue
  MOD_RES (2)..(2): Aib
  MOD_RES (39)..(39): The residue at this position is Lys modified with a Y2 group attached to its epsilon amino group

SEQ ID NO: 621 - protein, 39 aa, Artificial Sequence; identical to SEQ ID NO: 618
  Component of peptide hormone analogue
  MOD_RES (2)..(2): Aib
  MOD_RES (39)..(39): The residue at this position is Lys modified with a Y2 group attached to its epsilon amino group

SEQ ID NO: 622 - protein, 40 aa, Artificial Sequence
  Component of peptide hormone analogue
  MOD_RES (2)..(2): Aib
  MOD_RES (40)..(40): The residue at this position is Lys modified with a Y2 group attached to its epsilon amino group
HXHGTFTSDYSRYLDAKRAQEFIEWLLQSHHQHHESPPPK

SEQ ID NO: 623 - protein, 40 aa, Artificial Sequence; identical to SEQ ID NO: 622
  Component of peptide hormone analogue
  MOD_RES (2)..(2): Aib
  MOD_RES (40)..(40): The residue at this position is Lys modified with a Y2 group attached to its epsilon amino group

SEQ ID NO: 624 - protein, 40 aa, Artificial Sequence
  Component of peptide hormone analogue
  MOD_RES (2)..(2): Aib
  MOD_RES (40)..(40): The residue at this position is Lys modified with a Y2 group attached to its epsilon amino group
HXHGTFTSDYSRYLDAKRAQEFIEWLLQSHHQQHESPPPK

SEQ ID NO: 625 - protein, 40 aa, Artificial Sequence; identical to SEQ ID NO: 624
  Component of peptide hormone analogue
  MOD_RES (2)..(2): Aib
  MOD_RES (40)..(40): The residue at this position is Lys modified with a Y2 group attached to its epsilon amino group

SEQ ID NO: 626 - protein, 40 aa, Artificial Sequence
  Component of peptide hormone analogue
  MOD_RES (2)..(2): Aib
  MOD_RES (40)..(40): The residue at this position is Lys modified with a Y2 group attached to its epsilon amino group
HXHGTFTSDYSRYLDAKRAQEFIEWLLQSHQQHHESPPPK

SEQ ID NO: 627 - protein, 40 aa, Artificial Sequence; identical to SEQ ID NO: 626
  Component of peptide hormone analogue
  MOD_RES (2)..(2): Aib
  MOD_RES (40)..(40): The residue at this position is Lys modified with a Y2 group attached to its epsilon amino group

SEQ ID NO: 628 - protein, 40 aa, Artificial Sequence; identical to SEQ ID NO: 624
  Component of peptide hormone analogue
  MOD_RES (2)..(2): Aib
  MOD_RES (40)..(40): The residue at this position is Lys modified with a Y2 group attached to its epsilon amino group

SEQ ID NO: 629 - protein, 40 aa, Artificial Sequence; identical to SEQ ID NO: 626
  Component of peptide hormone analogue
  MOD_RES (2)..(2): Aib
  MOD_RES (40)..(40): The residue at this position is Lys modified with a Y2 group attached to its epsilon amino group

SEQ ID NO: 630 - protein, 40 aa, Artificial Sequence; identical to SEQ ID NO: 624
  Component of peptide hormone analogue
  MOD_RES (2)..(2): Aib
  MOD_RES (40)..(40): The residue at this position is Lys modified with a Y2 group attached to its epsilon amino group

SEQ ID NO: 631 - protein, 40 aa, Artificial Sequence; identical to SEQ ID NO: 626
  Component of peptide hormone analogue
  MOD_RES (2)..(2): Aib
  MOD_RES (40)..(40): The residue at this position is Lys modified with a Y2 group attached to its epsilon amino group

SEQ ID NO: 632 - protein, 40 aa, Artificial Sequence; identical to SEQ ID NO: 535
  Component of peptide hormone analogue
  MOD_RES (2)..(2): Aib
  MOD_RES (40)..(40): The residue at this position is Lys modified with a Y2 group attached to its epsilon amino group

SEQ ID NO: 633 - protein, 40 aa, Artificial Sequence; identical to SEQ ID NO: 535
  Component of peptide hormone analogue
  MOD_RES (2)..(2): Aib
  MOD_RES (40)..(40): The residue at this position is Lys modified with a Y2 group attached to its epsilon amino group

SEQ ID NO: 634 - protein, 40 aa, Artificial Sequence; identical to SEQ ID NO: 535
  Component of peptide hormone analogue
  MOD_RES (2)..(2): Aib
  MOD_RES (40)..(40): The residue at this position is Lys modified with a Y2 group attached to its epsilon amino group

SEQ ID NO: 635 - protein, 39 aa, Artificial Sequence
  Component of peptide hormone analogue
  MOD_RES (2)..(2): Aib
  MOD_RES (39)..(39): The residue at this position is Lys modified with a Y2 group attached to its epsilon amino group
HXHGTFTSDYSKYLDAKRAQEFIEWLLQSQQHESPPPGK

SEQ ID NO: 636 - protein, 41 aa, Artificial Sequence
  Component of peptide hormone analogue
  MOD_RES (2)..(2): Aib
  MOD_RES (41)..(41): The residue at this position is Lys modified with a Y2 group attached to its epsilon amino group
HXHGTFTSDYSKYLDAKRAQEFIEWLLQSHQHQHPSPPPGK

SEQ ID NO: 637 - protein, 40 aa, Artificial Sequence
  Component of peptide hormone analogue
  MOD_RES (2)..(2): Aib
  MOD_RES (40)..(40): The residue at this position is Lys modified with a Y2 group attached to its epsilon amino group
HXHGTFTSDYSKYLDAKRAQEFIEWLLQSHQHQHESPPPK

SEQ ID NO: 638 - protein, 41 aa, Artificial Sequence
  Component of peptide hormone analogue
  MOD_RES (2)..(2): Aib
  MOD_RES (41)..(41): The residue at this position is Lys modified with a Y2 group attached to its epsilon amino group
HXHGTFTSDYSKYLDAKRAQEFIEWLLQSHQHQHESPPPGK

SEQ ID NO: 639 - protein, 41 aa, Artificial Sequence; identical to SEQ ID NO: 638
  Component of peptide hormone analogue
  MOD_RES (2)..(2): Aib
  MOD_RES (41)..(41): The residue at this position is Lys modified with a Y2 group attached to its epsilon amino group

SEQ ID NO: 640 - protein, 41 aa, Artificial Sequence; identical to SEQ ID NO: 638
  Component of peptide hormone analogue
  MOD_RES (2)..(2): Aib
  MOD_RES (41)..(41): The residue at this position is Lys modified with a Y2 group attached to its epsilon amino group

SEQ ID NO: 641 - protein, 40 aa, Artificial Sequence; identical to SEQ ID NO: 603
  Component of peptide hormone analogue
  MOD_RES (2)..(2): Aib
  MOD_RES (40)..(40): The residue at this position is Lys modified with a Y2 group attached to its epsilon amino group

SEQ ID NO: 642 - protein, 41 aa, Artificial Sequence
  Component of peptide hormone analogue
  MOD_RES (2)..(2): Aib
  MOD_RES (41)..(41): The residue at this position is Lys modified with a Y2 group attached to its epsilon amino group
HXHGTFTSDYSKYLDAKRAQEFIEWLLQSHQQHHESPPPGK

SEQ ID NO: 643 - protein, 41 aa, Artificial Sequence; identical to SEQ ID NO: 642
  Component of peptide hormone analogue
  MOD_RES (2)..(2): Aib
  MOD_RES (41)..(41): The residue at this position is Lys modified with a Y2 group attached to its epsilon amino group

SEQ ID NO: 644 - protein, 40 aa, Artificial Sequence; identical to SEQ ID NO: 532
  Component of peptide hormone analogue
  MOD_RES (2)..(2): Aib
  MOD_RES (40)..(40): The residue at this position is Lys modified with a Y2 group attached to its epsilon amino group

SEQ ID NO: 645 - protein, 40 aa, Artificial Sequence; identical to SEQ ID NO: 603
  Component of peptide hormone analogue
  MOD_RES (2)..(2): Aib
  MOD_RES (40)..(40): The residue at this position is Lys modified with a Y2 group attached to its epsilon amino group

SEQ ID NO: 646 - protein, 41 aa, Artificial Sequence
  Component of peptide hormone analogue
  MOD_RES (2)..(2): Aib
  MOD_RES (41)..(41): The residue at this position is Lys modified with a Y2 group attached to its epsilon amino group
HXHGTFTSDYSKYLDAKRAQEFIEWLLQSHHQQHESPPPGK

SEQ ID NO: 647 - protein, 41 aa, Artificial Sequence; identical to SEQ ID NO: 646
  Component of peptide hormone analogue
  MOD_RES (2)..(2): Aib
  MOD_RES (41)..(41): The residue at this position is Lys modified with a Y2 group attached to its epsilon amino group

SEQ ID NO: 648 - protein, 40 aa, Artificial Sequence; identical to SEQ ID NO: 525
  Component of peptide hormone analogue
  MOD_RES (2)..(2): Aib
  MOD_RES (40)..(40): The residue at this position is Lys modified with a Y2 group attached to its epsilon amino group

SEQ ID NO: 649 - protein, 40 aa, Artificial Sequence; identical to SEQ ID NO: 549
  Component of peptide hormone analogue
  MOD_RES (2)..(2): Aib
  MOD_RES (40)..(40): The residue at this position is Lys modified with a Y2 group attached to its epsilon amino group

SEQ ID NO: 650 - protein, 39 aa, Artificial Sequence
  Component of peptide hormone analogue
  MOD_RES (2)..(2): Aib
  MOD_RES (39)..(39): The residue at this position is Lys modified with a Y2 group attached to its epsilon amino group
HXHGTFTSDYSKYLDAKRAHEFIEWLLQSHQQHSPPPGK

SEQ ID NO: 651 - protein, 39 aa, Artificial Sequence; identical to SEQ ID NO: 650
  Component of peptide hormone analogue
  MOD_RES (2)..(2): Aib
  MOD_RES (39)..(39): The residue at this position is Lys modified with a Y2 group attached to its epsilon amino group

SEQ ID NO: 652 - protein, 40 aa, Artificial Sequence
  Component of peptide hormone analogue
  MOD_RES (2)..(2): Aib
  MOD_RES (40)..(40): The residue at this position is Lys modified with a Y2 group attached to its epsilon amino group
HXHGTFTSDYSKYLDAKRAHEFIEWLLQSHQQHESPPPGK

SEQ ID NO: 653 - protein, 40 aa, Artificial Sequence; identical to SEQ ID NO: 652
  Component of peptide hormone analogue
  MOD_RES (2)..(2): Aib
  MOD_RES (40)..(40): The residue at this position is Lys modified with a Y2 group attached to its epsilon amino group

SEQ ID NO: 654 - protein, 40 aa, Artificial Sequence; identical to SEQ ID NO: 319
  Component of peptide hormone analogue
  MOD_RES (2)..(2): Aib
  MOD_RES (40)..(40): The residue at this position is Lys modified with a Y2 group attached to its epsilon amino group

SEQ ID NO: 655 - protein, 40 aa, Artificial Sequence
  Component of peptide hormone analogue
  MOD_RES (2)..(2): Aib
  MOD_RES (40)..(40): The residue at this position is Lys modified with a Y2 group attached to its epsilon amino group
HXHGTFTSDYSKYLDAKRAQEFIEWLLQSHQQHSESPPPK

SEQ ID NO: 656 - protein, 40 aa, Artificial Sequence; identical to SEQ ID NO: 603
  Component of peptide hormone analogue
  MOD_RES (2)..(2): Aib
  MOD_RES (40)..(40): The residue at this position is Lys modified with a Y2 group attached to its epsilon amino group

SEQ ID NO: 657 - protein, 40 aa, Artificial Sequence
  Component of peptide hormone analogue
  MOD_RES (2)..(2): Aib
  MOD_RES (40)..(40): The residue at this position is Lys modified with a Y2 group attached to its epsilon amino group
HXHGTFTSDYSKYLDAKRAQEFIEWLLQSQHQHHESPPPK

SEQ ID NO: 658 - protein, 40 aa, Artificial Sequence
  Component of peptide hormone analogue
  MOD_RES (2)..(2): Aib
  MOD_RES (40)..(40): The residue at this position is Lys modified with a Y2 group attached to its epsilon amino group
HXHGTFTSDYSKYLDAKRAQEFIEWLLQSQQHESESPPPK

SEQ ID NO: 659 - protein, 40 aa, Artificial Sequence
  Component of peptide hormone analogue
  MOD_RES (2)..(2): Aib
  MOD_RES (40)..(40): The residue at this position is Lys modified with a Y2 group attached to its epsilon amino group
HXHGTFTSDYSKYLDAKRAQEFIEWLLQSHHQQQESPPPK

SEQ ID NO: 660 - protein, 40 aa, Artificial Sequence; identical to SEQ ID NO: 549
  Component of peptide hormone analogue
  MOD_RES (2)..(2): Aib
  MOD_RES (40)..(40): The residue at this position is Lys modified with a Y2 group attached to its epsilon amino group

SEQ ID NO: 661 - protein, 40 aa, Artificial Sequence; identical to SEQ ID NO: 602
  Component of peptide hormone analogue
  MOD_RES (2)..(2): Aib
  MOD_RES (40)..(40): The residue at this position is Lys modified with a Y2 group attached to its epsilon amino group

SEQ ID NO: 662 - protein, 39 aa, Artificial Sequence
  Component of peptide hormone analogue
  MOD_RES (2)..(2): Aib
  MOD_RES (39)..(39): The residue at this position is Lys modified with a Y2 group attached to its epsilon amino group
HXHGTFTSDLSKQLEEKRVRLFIEWLKNGGPSHGHPPPK

SEQ ID NO: 663 - protein, 37 aa, Artificial Sequence
  Component of peptide hormone analogue
  MOD_RES (2)..(2): Aib
  MOD_RES (37)..(37): The residue at this position is Lys modified with a Y2 group attached to its epsilon amino group
HXHGTFTSDYSKYLDAKRAQEFIEWLLQSQQHESPPK

SEQ ID NO: 664 - protein, 38 aa, Artificial Sequence
  Component of peptide hormone analogue
  MOD_RES (2)..(2): Aib
  MOD_RES (38)..(38): The residue at this position is Lys modified with a Y2 group attached to its epsilon amino group
HXHGTFTSDYSKYLDAKRAQEFIEWLLQSQQHESSSGK

SEQ ID NO: 665 - protein, 42 aa, Artificial Sequence
  Component of peptide hormone analogue
  MOD_RES (2)..(2): Aib
  MOD_RES (42)..(42): The residue at this position is Lys modified with a Y2 group attached to its epsilon amino group
HXHGTFTSDYSKYLDAKRAQEFIEWLLQSHQQHESSGAPPGK

SEQ ID NO: 666 - protein, 41 aa, Artificial Sequence
  Component of peptide hormone analogue
  MOD_RES (2)..(2): Aib
  MOD_RES (41)..(41): The residue at this position is Lys modified with a Y2 group attached to its epsilon amino group
HXHGTFTSDYSKYLDAKRAQEFIEWLLQSHQQHESSGAPGK

SEQ ID NO: 667 - protein, 40 aa, Artificial Sequence
  Component of peptide hormone analogue
  MOD_RES (2)..(2): Aib
  MOD_RES (40)..(40): The residue at this position is Lys modified with a Y2 group attached to its epsilon amino group
HXHGTFTSDYSKYLDAKRAQEFIEWLLQSHQQHESSGAGK

SEQ ID NO: 668 - protein, 38 aa, Artificial Sequence
  Component of peptide hormone analogue
  MOD_RES (2)..(2): Aib
  MOD_RES (38)..(38): The residue at this position is Lys modified with a Y2 group attached to its epsilon amino group
HXHGTFTSDYSKYLDAKRAHEFIEWLLQSHQQHESGAK

SEQ ID NO: 669 - protein, 39 aa, Artificial Sequence
  Component of peptide hormone analogue
  MOD_RES (2)..(2): Aib
  MOD_RES (39)..(39): The residue at this position is Lys modified with a Y2 group attached to its epsilon amino group
HXHGTFTSDYSKYLDAKRAHEFIEWLLQSHQQHESGAGK

SEQ ID NO: 670 - protein, 37 aa, Artificial Sequence
  Component of peptide hormone analogue
  MOD_RES (2)..(2): Aib
  MOD_RES (37)..(37): The residue at this position is Lys modified with a Y2 group attached to its epsilon amino group
HXHGTFTSDYSKYLDAKRAQEFIEWLLQSQQHESAGK

SEQ ID NO: 671 - protein, 38 aa, Artificial Sequence
  Component of peptide hormone analogue
  MOD_RES (2)..(2): Aib
  MOD_RES (38)..(38): The residue at this position is Lys modified with a Y2 group attached to its epsilon amino group
HXHGTFTSDYSKYLDAKRAQEFIEWLLQSQQHESSGAK

SEQ ID NO: 672 - protein, 38 aa, Artificial Sequence
  Component of peptide hormone analogue
  MOD_RES (2)..(2): Aib
  MOD_RES (38)..(38): The residue at this position is Lys modified with a Y2 group attached to its epsilon amino group
HXHGTFTSDYSKYLDAKRAQEFIEWLLQSHQHESSGAK

SEQ ID NO: 673 - protein, 39 aa, Artificial Sequence
  Component of peptide hormone analogue
  MOD_RES (2)..(2): Aib
  MOD_RES (39)..(39): The residue at this position is Lys modified with a Y2 group attached to its epsilon amino group
HXHGTFTSDYSKYLDAKRAHEFIEWLLQSHQQHESSASK

SEQ ID NO: 674 - protein, 39 aa, Artificial Sequence
  Component of peptide hormone analogue
  MOD_RES (2)..(2): Aib
  MOD_RES (39)..(39): The residue at this position is Lys modified with a Y2 group attached to its epsilon amino group
HXHGTFTSDYSKYLDAKRAHEFIEWLLQSHQQHESSAGK

SEQ ID NO: 675 - protein, 39 aa, Artificial Sequence; identical to SEQ ID NO: 674
  Component of peptide hormone analogue
  MOD_RES (2)..(2): Aib
  MOD_RES (39)..(39): The residue at this position is Lys modified with a Y2 group attached to its epsilon amino group

SEQ ID NO: 676 - protein, 39 aa, Artificial Sequence; identical to SEQ ID NO: 674
  Component of peptide hormone analogue
  MOD_RES (2)..(2): Aib
  MOD_RES (39)..(39): The residue at this position is Lys modified with a Y2 group attached to its epsilon amino group

SEQ ID NO: 677 - protein, 39 aa, Artificial Sequence; identical to SEQ ID NO: 674
  Component of peptide hormone analogue
  MOD_RES (2)..(2): Aib
  MOD_RES (39)..(39): The residue at this position is Lys modified with a Y2 group attached to its epsilon amino group

SEQ ID NO: 678 - protein, 38 aa, Artificial Sequence; identical to SEQ ID NO: 671
  Component of peptide hormone analogue
  MOD_RES (2)..(2): Aib
  MOD_RES (38)..(38): The residue at this position is Lys modified with a Y2 group attached to its epsilon amino group

SEQ ID NO: 679 - protein, 38 aa, Artificial Sequence; identical to SEQ ID NO: 495
  Component of peptide hormone analogue
  MOD_RES (2)..(2): Aib
  MOD_RES (38)..(38): The residue at this position is Lys modified with a Y2 group attached to its epsilon amino group

SEQ ID NO: 680 - protein, 39 aa, Artificial Sequence
  Component of peptide hormone analogue
  MOD_RES (2)..(2): Aib
  MOD_RES (39)..(39): The residue at this position is Lys modified with a Y2 group attached to its epsilon amino group
HXHGTFTSDYSKYLDAKRAQEFIEWLLQSHHQQHESSGK

SEQ ID NO: 681 - protein, 38 aa, Artificial Sequence
  Component of peptide hormone analogue
  MOD_RES (2)..(2): Aib
  MOD_RES (38)..(38): The residue at this position is Lys modified with a Y2 group attached to its epsilon amino group
HXHGTFTSDYSKYLDAKRAQEFIEWLLQSHHQQHESGK

SEQ ID NO: 682 - protein, 37 aa, Artificial Sequence
  Component of peptide hormone analogue
  MOD_RES (2)..(2): Aib
  MOD_RES (37)..(37): The residue at this position is Lys modified with a Y2 group attached to its epsilon amino group
HXHGTFTSDYSKYLDAKRAQEFIEWLLQSHHQQHEGK

SEQ ID NO: 683 - protein, 42 aa, Artificial Sequence; identical to SEQ ID NO: 243
  Component of peptide hormone analogue
  MOD_RES (2)..(2): Aib
  MOD_RES (42)..(42): The residue at this position is Lys modified with a Y2 group attached to its epsilon amino group

SEQ ID NO: 684 - protein, 40 aa, Artificial Sequence; identical to SEQ ID NO: 637
  Component of peptide hormone analogue
  MOD_RES (2)..(2): Aib
  MOD_RES (40)..(40): The residue at this position is Lys modified with a Y2 group attached to its epsilon amino group

SEQ ID NO: 685 - protein, 38 aa, Artificial Sequence
  Component of peptide hormone analogue
  MOD_RES (2)..(2): Aib
  MOD_RES (38)..(38): The residue at this position is Lys modified with a Y2 group attached to its epsilon amino group
HXHGTFTSDYSKYLDAKRAQEFIEWLLQSHQHQHESGK

SEQ ID NO: 686 - protein, 39 aa, Artificial Sequence
  Component of peptide hormone analogue
  MOD_RES (2)..(2): Aib
  MOD_RES (39)..(39): The residue at this position is Lys modified with a Y2 group attached to its epsilon amino group
HXHGTFTSDYSKYLDAKRAQEFIEWLLQSHQHQHESPGK

SEQ ID NO: 687 - protein, 38 aa, Artificial Sequence; identical to SEQ ID NO: 685
  Component of peptide hormone analogue
  MOD_RES (2)..(2): Aib
  MOD_RES (38)..(38): The residue at this position is Lys modified with a Y2 group attached to its epsilon amino group

SEQ ID NO: 688 - protein, 37 aa, Artificial Sequence; identical to SEQ ID NO: 682
  Component of peptide hormone analogue
  MOD_RES (2)..(2): Aib
  MOD_RES (37)..(37): The residue at this position is Lys modified with a Y2 group attached to its epsilon amino group

SEQ ID NO: 689 - protein, 37 aa, Artificial Sequence; identical to SEQ ID NO: 682
  Component of peptide hormone analogue
  MOD_RES (2)..(2): Aib
  MOD_RES (37)..(37): The residue at this position is Lys modified with a Y2 group attached to its epsilon amino group

SEQ ID NO: 690 - protein, 39 aa, Artificial Sequence
  Component of peptide hormone analogue
  MOD_RES (2)..(2): Aib
  MOD_RES (39)..(39): The residue at this position is Lys modified with a Y2 group attached to its epsilon amino group
HXHGTFTSDYSKYLDAKRAQEFIEWLLQSHHQQHESPGK

SEQ ID NO: 691 - protein, 40 aa, Artificial Sequence
  Component of peptide hormone analogue
  MOD_RES (2)..(2): Aib
  MOD_RES (40)..(40): The residue at this position is Lys modified with a Y2 group attached to its epsilon amino group
HXHGTFTSDYSKYLDAKRAQEFIEWLLQSHHQQHESPPGK

SEQ ID NO: 692 - protein, 41 aa, Artificial Sequence; identical to SEQ ID NO: 646
  Component of peptide hormone analogue
  MOD_RES (2)..(2): Aib
  MOD_RES (41)..(41): The residue at this position is Lys modified with a Y2 group attached to its epsilon amino group

SEQ ID NO: 693 - protein, 40 aa, Artificial Sequence; identical to SEQ ID NO: 652
  Component of peptide hormone analogue
  MOD_RES (2)..(2): Aib
  MOD_RES (40)..(40): The residue at this position is Lys modified with a Y2 group attached to its epsilon amino group

SEQ ID NO: 694 - protein, 41 aa, Artificial Sequence; identical to SEQ ID NO: 646
  Component of peptide hormone analogue
  MOD_RES (2)..(2): Aib
  MOD_RES (41)..(41): The residue at this position is Lys modified with a Y2 group attached to its epsilon amino group

SEQ ID NO: 695 - protein, 40 aa, Artificial Sequence
  Component of peptide hormone analogue
  MOD_RES (2)..(2): Aib
  MOD_RES (40)..(40): The residue at this position is Lys modified with a Y2 group attached to its epsilon amino group
HXHGTFTSDYSKYLDAKRAQEFIEWLLQSHHQQHESSSGK

SEQ ID NO: 696 - protein, 38 aa, Artificial Sequence
  Component of peptide hormone analogue
  MOD_RES (2)..(2): Aib
  MOD_RES (38)..(38): The residue at this position is Lys modified with a Y2 group attached to its epsilon amino group
HXHGTFTSDYSKYLDAKRAHEFIEWLLQSHQQHESSGK

SEQ ID NO: 697 - protein, 38 aa, Artificial Sequence; identical to SEQ ID NO: 492
  Component of peptide hormone analogue
  MOD_RES (2)..(2): Aib
  MOD_RES (38)..(38): The residue at this position is Lys modified with a Y2 group attached to its epsilon amino group

SEQ ID NO: 698 - protein, 40 aa, Artificial Sequence; identical to SEQ ID NO: 652
  Component of peptide hormone analogue
  MOD_RES (2)..(2): Aib
  MOD_RES (40)..(40): The residue at this position is Lys modified with a Y2 group attached to its epsilon amino group

SEQ ID NO: 699 - protein, 39 aa, Artificial Sequence
  Component of peptide hormone analogue
  MOD_RES (2)..(2): Aib
  MOD_RES (39)..(39): The residue at this position is Lys modified with a Y2 group attached to its epsilon amino group
HXHGTFTSDYSKYLDAKRAQEFIEWLLQSHQQHESSGAK

SEQ ID NO: 700 - protein, 40 aa, Artificial Sequence; identical to SEQ ID NO: 652
  Component of peptide hormone analogue
  MOD_RES (2)..(2): Aib
  MOD_RES (40)..(40): The residue at this position is Lys modified with a Y2 group attached to its epsilon amino group

SEQ ID NO: 701 - protein, 41 aa, Artificial Sequence; identical to SEQ ID NO: 646
  Component of peptide hormone analogue
  MOD_RES (2)..(2): Aib
  MOD_RES (41)..(41): The residue at this position is Lys modified with a Y2 group attached to its epsilon amino group

SEQ ID NO: 702 - protein, 38 aa, Artificial Sequence; identical to SEQ ID NO: 685
  Component of peptide hormone analogue
  MOD_RES (2)..(2): Aib
  MOD_RES (38)..(38): The residue at this position is Lys modified with a Y2 group attached to its epsilon amino group

SEQ ID NO: 703 - protein, 38 aa, Artificial Sequence; identical to SEQ ID NO: 671
  Component of peptide hormone analogue
  MOD_RES (2)..(2): Aib
  MOD_RES (38)..(38): The residue at this position is Lys modified with a Y2 group attached to its epsilon amino group

SEQ ID NO: 704 - protein, 40 aa, Artificial Sequence
  Component of peptide hormone analogue
  MOD_RES (2)..(2): Aib
  MOD_RES (40)..(40): The residue at this position is Lys modified with a Y2 group attached to its epsilon amino group
HXHGTFTSDYSKYLDAKRAREFIEWLLQSHQQHESPPPGK

SEQ ID NO: 705 - protein, 40 aa, Artificial Sequence
  Component of peptide hormone analogue
  MOD_RES (2)..(2): Aib
  MOD_RES (40)..(40): The residue at this position is Lys modified with a Y2 group attached to its epsilon amino group
HXHGTFTSDYSKYLDAKRAREFIEWLLQSHQQHPSPPPGK

SEQ ID NO: 706 - protein, 40 aa, Artificial Sequence
  Component of peptide hormone analogue
  MOD_RES (2)..(2): Aib
  MOD_RES (40)..(40): The residue at this position is Lys modified with a Y2 group attached to its epsilon amino group
HXHGTFTSDYSKYLDAKRAQEFIEWLLQSHQQHPSPPPGK

SEQ ID NO: 707 - protein, 40 aa, Artificial Sequence
  Component of peptide hormone analogue
  MOD_RES (2)..(2): Aib
  MOD_RES (40)..(40): The residue at this position is Lys modified with a Y2 group attached to its epsilon amino group
HXHGTFTSDYSKYLDAKRAQEFIEWLLQSHQQHPSSSSAK

SEQ ID NO: 708 - protein, 39 aa, Artificial Sequence
  Component of peptide hormone analogue
  MOD_RES (2)..(2): Aib
  MOD_RES (39)..(39): The residue at this position is Lys modified with a Y2 group attached to its epsilon amino group
HXHGTFTSDYSKYLDAKRAQEFIEWLLQSHQQHPSSSAK

SEQ ID NO: 709 - protein, 39 aa, Artificial Sequence
  Component of peptide hormone analogue
  MOD_RES (2)..(2): Aib
  MOD_RES (39)..(39): The residue at this position is Lys modified with a Y2 group attached to its epsilon amino group
HXHGTFTSDYSKYLDAKRAHEFIEWLLQSHQQHPSSSAK

SEQ ID NO: 710 - protein, 40 aa, Artificial Sequence
  Component of peptide hormone analogue
  MOD_RES (2)..(2): Aib
  MOD_RES (40)..(40): The residue at this position is Lys modified with a Y2 group attached to its epsilon amino group
HXHGTFTSDYSKYLDAKRAQEFIEWLLQSHQQHHPSSSAK

SEQ ID NO: 711 - protein, 40 aa, Artificial Sequence; identical to SEQ ID NO: 710
  Component of peptide hormone analogue
  MOD_RES (2)..(2): Aib
  MOD_RES (40)..(40): The residue at this position is Lys modified with a Y2 group attached to its epsilon amino group

SEQ ID NO: 712 - protein, 41 aa, Artificial Sequence
  Component of peptide hormone analogue
  MOD_RES (2)..(2): Aib
  MOD_RES (41)..(41): The residue at this position is Lys modified with a Y2 group attached to its epsilon amino group
HXHGTFTSDYSKYLDAKRAQEFIEWLLQSHHQQHPSPPPGK

SEQ ID NO: 713 - protein, 38 aa, Artificial Sequence
  Component of peptide hormone analogue
  MOD_RES (2)..(2): Aib
  MOD_RES (38)..(38): The residue at this position is Lys modified with a Y2 group attached to its epsilon amino group
HXHGTFTSDYSKYLDAKRAREFIEWLLQSHQHQHESGK

SEQ ID NO: 714 - protein, 37 aa, Artificial Sequence
  Component of peptide hormone analogue
  MOD_RES (2)..(2): Aib
  MOD_RES (37)..(37): The residue at this position is Lys modified with a Y2 group attached to its epsilon amino group
HXHGTFTSDYSKYLDAKRAREFIEWLLQSHHQQHEGK

SEQ ID NO: 715 - protein, 38 aa, Artificial Sequence
  Component of peptide hormone analogue
  MOD_RES (2)..(2): Aib
  MOD_RES (38)..(38): The residue at this position is Lys modified with a Y2 group attached to its epsilon amino group
HXHGTFTSDYSKYLDAKRAREFIEWLLQSHQHQHPSGK

SEQ ID NO: 716 - protein, 37 aa, Artificial Sequence
  Component of peptide hormone analogue
  MOD_RES (2)..(2): Aib
  MOD_RES (37)..(37): The residue at this position is Lys modified with a Y2 group attached to its epsilon amino group
HXHGTFTSDYSKYLDAKRAREFIEWLLQSHHQQHPGK

SEQ ID NO: 717 - protein, 38 aa, Artificial Sequence; identical to SEQ ID NO: 713
  Component of peptide hormone analogue
  MOD_RES (2)..(2): Aib
  MOD_RES (38)..(38): The residue at this position is Lys modified with a Y2 group attached to its epsilon amino group

SEQ ID NO: 718 - protein, 38 aa, Artificial Sequence; identical to SEQ ID NO: 715
  Component of peptide hormone analogue
  MOD_RES (2)..(2): Aib
  MOD_RES (38)..(38): The residue at this position is Lys modified with a Y2 group attached to its epsilon amino group

SEQ ID NO: 719 - protein, 38 aa, Artificial Sequence
  Component of peptide hormone analogue
  MOD_RES (2)..(2): Aib
  MOD_RES (38)..(38): The residue at this position is Lys modified with a Y2 group attached to its epsilon amino group
HXHGTFTSDYSKYLDAKRAREFIEWLLQSQQHPSSGAK

SEQ ID NO: 720 - protein, 41 aa, Artificial Sequence; identical to SEQ ID NO: 646
  Component of peptide hormone analogue
  MOD_RES (2)..(2): Aib
  MOD_RES (41)..(41): The residue at this position is Lys modified with a Y2 group attached to its epsilon amino group

SEQ ID NO: 721 - protein, 40 aa, Artificial Sequence; identical to SEQ ID NO: 652
  Component of peptide hormone analogue
  MOD_RES (2)..(2): Aib
  MOD_RES (40)..(40): The residue at this position is Lys modified with a Y2 group attached to its epsilon amino group

SEQ ID NO: 722 - protein, 40 aa, Artificial Sequence; identical to SEQ ID NO: 707
  Component of peptide hormone analogue
  MOD_RES (2)..(2): Aib
  MOD_RES (40)..(40): The residue at this position is Lys modified with a Y2 group attached to its epsilon amino group

SEQ ID NO: 723 - protein, 38 aa, Artificial Sequence; identical to SEQ ID NO: 713
  Component of peptide hormone analogue
  MOD_RES (2)..(2): Aib
  MOD_RES (38)..(38): The residue at this position is Lys modified with a Y2 group attached to its epsilon amino group

SEQ ID NO: 724 - protein, 42 aa, Artificial Sequence
  Component of peptide hormone analogue
  MOD_RES (2)..(2): Aib
  MOD_RES (42)..(42): The residue at this position is Lys modified with a Y2 group attached to its epsilon amino group
HXHGTFTSDYSKYLDAKRAREFIEWLLQSHQQHPSSGAPPGK

SEQ ID NO: 725 - protein, 39 aa, Artificial Sequence; identical to SEQ ID NO: 708
  Component of peptide hormone analogue
  MOD_RES (2)..(2): Aib
  MOD_RES (39)..(39): The residue at this position is Lys modified with a Y2 group attached to its epsilon amino group

SEQ ID NO: 726 - protein, 39 aa, Artificial Sequence
  Component of peptide hormone analogue
  MOD_RES (2)..(2): Aib
  MOD_RES (39)..(39): The residue at this position is Lys modified with a Y2 group attached to its epsilon amino group
HXHGTFTSDYSKYLDAKRAREFIEWLLQSHQQHPSSSAK

SEQ ID NO: 727 - protein, 42 aa, Artificial Sequence
  Component of peptide hormone analogue
  MOD_RES (2)..(2): Aib
  MOD_RES (42)..(42): The residue at this position is Lys modified with a Y2 group attached to its epsilon amino group
HXHGTFTSDYSKYLDAKRAQEFIEWLKQSHQQHESSGAPPGK

SEQ ID NO: 728 - protein, 41 aa, Artificial Sequence
  Component of peptide hormone analogue
  MOD_RES (2)..(2): Aib
  MOD_RES (41)..(41): The residue at this position is Lys modified with a Y2 group attached to its epsilon amino group
HXHGTFTSDYSKYLDAKRAQEFIEWLKQSHQHQHESPPPGK

SEQ ID NO: 729 - protein, 38 aa, Artificial Sequence
  Component of peptide hormone analogue
  MOD_RES (2)..(2): Aib
  MOD_RES (38)..(38): The residue at this position is Lys modified with a Y2 group attached to its epsilon amino group
HXHGTFTSDYSKYLDAKRAQEFIEWLKQSHQHQHESGK

SEQ ID NO: 730 - protein, 42 aa, Artificial Sequence
  Component of peptide hormone analogue
  MOD_RES (2)..(2): Aib
  MOD_RES (42)..(42): The residue at this position is Lys modified with a Y2 group attached to its epsilon amino group
HXHGTFTSDYSKYLDAKRAQEFIEWLKQGHQQHESSGAPPGK

SEQ ID NO: 731 - protein, 41 aa, Artificial Sequence
  Component of peptide hormone analogue
  MOD_RES (2)..(2): Aib
  MOD_RES (41)..(41): The residue at this position is Lys modified with a Y2 group attached to its epsilon amino group
HXHGTFTSDYSKYLDAKRAQEFIEWLKQGHQHQHESPPPGK

SEQ ID NO: 732 - protein, 38 aa, Artificial Sequence
  Component of peptide hormone analogue
  MOD_RES (2)..(2): Aib
  MOD_RES (38)..(38): The residue at this position is Lys modified with a Y2 group attached to its epsilon amino group
HXHGTFTSDYSKYLDAKRAQEFIEWLKQGHQHQHESGK

SEQ ID NO: 733 - protein, 40 aa, Artificial Sequence
  Component of peptide hormone analogue
  MOD_RES (2)..(2): Aib
  MOD_RES (40)..(40): The residue at this position is Lys modified with a Y2 group attached to its epsilon amino group
HXHGTFTSDLSKQLEEKRVRLFIEWLKQGGPSHGHPPPGK

SEQ ID NO: 734 - protein, 40 aa, Artificial Sequence; identical to SEQ ID NO: 706
  Component of peptide hormone analogue
  MOD_RES (2)..(2): Aib
  MOD_RES (40)..(40): The residue at this position is Lys modified with a Y2 group attached to its epsilon amino group

SEQ ID NO: 735 - protein, 41 aa, Artificial Sequence
  Component of peptide hormone analogue
  MOD_RES (2)..(2): Aib
  MOD_RES (41)..(41): The residue at this position is Lys modified with a Y2 group attached to its epsilon amino group
HXHGTFTSDYSKYLEEKRAQEFIEWLKQGGPHQHESPPPGK

SEQ ID NO: 736 - protein, 40 aa, Artificial Sequence
  Component of peptide hormone analogue
  MOD_RES (2)..(2): Aib
  MOD_RES (40)..(40): The residue at this position is Lys modified with a Y2 group attached to its epsilon amino group
HXHGTFTSDYSKYLEEKRAQEFIEWLKQGGPQHPSPPPGK

SEQ ID NO: 737 - protein, 41 aa, Artificial Sequence; identical to SEQ ID NO: 638
  Component of peptide hormone analogue
  MOD_RES (2)..(2): Aib
  MOD_RES (41)..(41): The residue at this position is Lys modified with a Y2 group attached to its epsilon amino group

SEQ ID NO: 738 - protein, 4 aa, Artificial Sequence
  Component of peptide hormone analogue
GSGS

SEQ ID NO: 739 - protein, 4 aa, Artificial Sequence
  Component of peptide hormone analogue
GSSG

SEQ ID NO: 740 - protein, 4 aa, Artificial Sequence
  Component of peptide hormone analogue
TGSG

SEQ ID NO: 741 - protein, 4 aa, Artificial Sequence
  Component of peptide hormone analogue
GSGT

SEQ ID NO: 742 - protein, 29 aa, Artificial Sequence
  Component of peptide hormone analogue
  VARIANT (2)..(2): The residue at this position is AIB or Ser
  VARIANT (3)..(3): The residue at this position is His, Glu, Gln, Asp or Phe
  VARIANT (10)..(10): The residue at this position is Leu, Tyr or Val
  VARIANT (12)..(12): The residue at this position is Arg, Lys or His
  VARIANT (13)..(13): The residue at this position is Tyr, Gln or His
  VARIANT (15)..(15): The residue at this position is Asp or Glu
  VARIANT (16)..(16): The residue at this position is Ala, Gln, Glu, Ser, His or Thr
  VARIANT (17)..(17): The residue at this position is Arg, Glu, His or Lys
  VARIANT (18)..(18): The residue at this position is Ala, Arg or Lys
  VARIANT (19)..(19): The residue at this position is Ala or Val
  VARIANT (20)..(20): The residue at this position is Arg, Gln or His
  VARIANT (21)..(21): The residue at this position is Asp, Leu, His or Glu
  VARIANT (23)..(23): The residue at this position is Ile or Val
  VARIANT (24)..(24): The residue at this position is Gln or Glu
  VARIANT (27)..(27): The residue at this position is Asn, Leu or Lys
  VARIANT (28)..(28): The residue at this position is Ala, Asn, Gln, Gly, His, Thr, Leu, Ser, or Ile
  VARIANT (29)..(29): The residue at this position is Gly, His, Ser or Thr
HXDGTFTSDLSRQLDARAARDFIQWLNAG

SEQ ID NO: 743 - protein, 5 aa, Artificial Sequence
  Component of peptide hormone analogue
  VARIANT (1)..(1): The residue at this position is His, Gly, Ala, Glu, Gln, Pro or Ser
  VARIANT (2)..(2): The residue at this position is His, Gly, Ala, Glu, Gln, Pro or Ser
  VARIANT (3)..(3): The residue at this position is His, Gly, Ala, Glu, Gln, Pro or Ser
  VARIANT (4)..(4): The residue at this position is His, Gly, Ala, Glu, Gln, Pro or Ser
  VARIANT (5)..(5): The residue at this position is His, Gly, Ala, Glu, Gln, Pro or Ser
HHHHH

SEQ ID NO: 744 - protein, 10 aa, Artificial Sequence
  Component of peptide hormone analogue
  VARIANT (1)..(1): The residue at this position is Pro, His, Glu, Ser or Ala
  VARIANT (2)..(2): The residue at this position is Ser, Gly, Pro or Thr
  VARIANT (3)..(3): The residue at this position is Pro, Ala, Ser, Glu, Gly or absent
  VARIANT (4)..(4): The residue at this position is Pro, Ala, Gly, Ser or absent
  VARIANT (5)..(5): The residue at this position is Pro, Gly, Ala, Ser or absent
  VARIANT (6)..(6): The residue at this position is Pro, Gly, Ser or absent
  VARIANT (7)..(7): The residue at this position is Gly, Ser or absent
  MOD_RES (8)..(8): The residue at this position is Lys modified with a Y2 group attached to its epsilon amino group
  VARIANT (9)..(9): The residue at this position is Ser or absent
  VARIANT (10)..(10): The residue at this position is Trp or absent
AGAAAGGKSW

SEQ ID NO: 745 - protein, 4 aa, Artificial Sequence
  Component of peptide hormone analogue
  VARIANT (1)..(1): The residue at this position is Ser, Gly, Thr or absent
  VARIANT (2)..(2): The residue at this position is Ser, Gly, Thr or absent
  VARIANT (3)..(3): The residue at this position is Gly, Asn, Ser, Gln, Thr, His, Tyr, Ala or absent
  VARIANT (4)..(4): The residue at this position is Ser, Thr, His, Gln, Gly, Asn or absent
GGAN

SEQ ID NO: 746 - protein, 31 aa, Homo sapiens
HAEGTFTSDVSSYLEGQAAKEFIAWLVKGRG

SEQ ID NO: 747 - protein, 30 aa, Homo sapiens
  MOD_RES (30)..(30): AMIDATION
HAEGTFTSDVSSYLEGQAAKEFIAWLVKGR

SEQ ID NO: 748 - protein, 29 aa, Homo sapiens
HSQGTFTSDYSKYLDSRRAQDFVQWLMNT

SEQ ID NO: 749 - protein, 37 aa, Homo sapiens
HSQGTFTSDYSKYLDSRRAQDFVQWLMNTKRNRNNIA

SEQ ID NO: 750 - protein, 29 aa, Artificial Sequence
  Component of peptide hormone analogue
  MOD_RES (2)..(2): AIB
  VARIANT (12)..(12): The residue at this position is Arg or Lys
  VARIANT (16)..(16): The residue at this position is Ala, Gln or Glu
  VARIANT (17)..(17): The residue at this position is Arg or Lys
  VARIANT (20)..(20): The residue at this position is Arg, Gln or His
  VARIANT (28)..(28): The residue at this position is Ala, Asn, Gln or His
  VARIANT (29)..(29): The residue at this position is Gly, Ser or Thr
HXHGTFTSDYSRYLDARRAREFIEWLLAG

SEQ ID NO: 751 - protein, 29 aa, Artificial Sequence
  Component of peptide hormone analogue
  MOD_RES (2)..(2): AIB
  VARIANT (20)..(20): The residue at this position is Arg, Gln or His
HXHGTFTSDYSKYLDAKRAREFIEWLLQS

SEQ ID NO: 752 - protein, 5 aa, Artificial Sequence
  Component of peptide hormone analogue
GHHHH

SEQ ID NO: 753 - protein, 5 aa, Artificial Sequence
  Component of peptide hormone analogue
HHHHH

SEQ ID NO: 754 - protein, 5 aa, Artificial Sequence
  Component of peptide hormone analogue
HHQHH

SEQ ID NO: 755 - protein, 5 aa, Artificial Sequence
  Component of peptide hormone analogue
HQQQH

SEQ ID NO: 756 - protein, 5 aa, Artificial Sequence
  Component of peptide hormone analogue
HQHPS

SEQ ID NO: 757 - protein, 5 aa, Artificial Sequence
  Component of peptide hormone analogue
HQHES

SEQ ID NO: 758 - protein, 5 aa, Artificial Sequence
  Component of peptide hormone analogue
HHQES

SEQ ID NO: 759 - protein, 5 aa, Artificial Sequence
  Component of peptide hormone analogue
HHQSP

SEQ ID NO: 760 - protein, 5 aa, Artificial Sequence
  Component of peptide hormone analogue
HEPSP

SEQ ID NO: 761 - protein, 5 aa, Artificial Sequence
  Component of peptide hormone analogue
HEESP

SEQ ID NO: 762 - protein, 5 aa, Artificial Sequence
  Component of peptide hormone analogue
HQQES

SEQ ID NO: 763 - protein, 5 aa, Artificial Sequence
  Component of peptide hormone analogue
QHQHQ

SEQ ID NO: 764 - protein, 5 aa, Artificial Sequence
  Component of peptide hormone analogue
HQQHH

SEQ ID NO: 765 - protein, 5 aa, Artificial Sequence
  Component of peptide hormone analogue
HHQHQ

SEQ ID NO: 766 - protein, 5 aa, Artificial Sequence
  Component of peptide hormone analogue
HHQQH

SEQ ID NO: 767 - protein, 5 aa, Artificial Sequence
  Component of peptide hormone analogue
HQESP

SEQ ID NO: 768 - protein, 5 aa, Artificial Sequence
  Component of peptide hormone analogue
HQQPS

SEQ ID NO: 769 - protein, 5 aa, Artificial Sequence
  Component of peptide hormone analogue
QQHPS

SEQ ID NO: 770 - protein, 5 aa, Artificial Sequence
  Component of peptide hormone analogue
QQHES

SEQ ID NO: 771 - protein, 5 aa, Artificial Sequence
  Component of peptide hormone analogue
HQQSP

SEQ ID NO: 772 - protein, 5 aa, Artificial Sequence
  Component of peptide hormone analogue
HQQHS

SEQ ID NO: 773 - protein, 5 aa, Artificial Sequence
  Component of peptide hormone analogue
HQGAP

SEQ ID NO: 774 - protein, 5 aa, Artificial Sequence
  Component of peptide hormone analogue
GHGAP

SEQ ID NO: 775 - protein, 5 aa, Artificial Sequence
  Component of peptide hormone analogue
HGQGA

SEQ ID NO: 776 - protein, 5 aa, Artificial Sequence
  Component of peptide hormone analogue
HQQHE

SEQ ID NO: 777 - protein, 5 aa, Artificial Sequence
  Component of peptide hormone analogue
HPSSG

SEQ ID NO: 778 - protein, 5 aa, Artificial Sequence
  Component of peptide hormone analogue
QHQHP

SEQ ID NO: 779 - protein, 5 aa, Artificial Sequence
  Component of peptide hormone analogue
QHQHH

SEQ ID NO: 780 - protein, 5 aa, Artificial Sequence
  Component of peptide hormone analogue
HQHQH

SEQ ID NO: 781 - protein, 5 aa, Artificial Sequence
  Component of peptide hormone analogue
GPHSG

SEQ ID NO: 782 - protein, 5 aa, Artificial Sequence
  Component of peptide hormone analogue
HPHSG

SEQ ID NO: 783 - protein, 5 aa, Artificial Sequence
  Component of peptide hormone analogue
GPHHG

SEQ ID NO: 784 - protein, 5 aa, Artificial Sequence
  Component of peptide hormone analogue
HHQQQ

SEQ ID NO: 785 - protein, 5 aa, Artificial Sequence
  Component of peptide hormone analogue
GPSHG

SEQ ID NO: 786 - protein, 5 aa, Artificial Sequence
  Component of peptide hormone analogue
GHSSG

SEQ ID NO: 787 - protein, 5 aa, Artificial Sequence
  Component of peptide hormone analogue
HQHSG

SEQ ID NO: 788 - protein, 5 aa, Artificial Sequence
  Component of peptide hormone analogue
HHESP

SEQ ID NO: 789 - protein, 5 aa, Artificial Sequence
  Component of peptide hormone analogue
HHSSG

SEQ ID NO: 790 - protein, 5 aa, Artificial Sequence
  Component of peptide hormone analogue
HQQHG

SEQ ID NO: 791 - protein, 5 aa, Artificial Sequence
  Component of peptide hormone analogue
HHQHE

SEQ ID NO: 792 - protein, 5 aa, Artificial Sequence
  Component of peptide hormone analogue
HQQHP

SEQ ID NO: 793 - protein, 5 aa, Artificial Sequence
  Component of peptide hormone analogue
GPHQH

SEQ ID NO: 794 - protein, 5 aa, Artificial Sequence
  Component of peptide hormone analogue
GPQHP

SEQ ID NO: 795 - protein, 5 aa, Artificial Sequence
  Component of peptide hormone analogue
  VARIANT (1)..(1): The residue at this position is His or Gln
  VARIANT (2)..(2): The residue at this position is His or Gln
  VARIANT (3)..(3): The residue at this position is His or Gln
  VARIANT (4)..(4): The residue at this position is His, Gln, Glu or Pro
  VARIANT (5)..(5): The residue at this position is His, Glu, Pro or Ser
HHHHH

SEQ ID NO: 796 - protein, 5 aa, Artificial Sequence
  Component of peptide hormone analogue
  VARIANT (1)..(1): The residue at this position is His, Gly, Ala, Glu, Gln or Ser
  VARIANT (2)..(2): The residue at this position is His, Gly, Ala, Glu, Gln or Ser
  VARIANT (3)..(3): The residue at this position is His, Gly, Ala, Glu, Gln or Ser
  VARIANT (4)..(4): The residue at this position is His, Gly, Ala, Glu, Gln or Ser
  VARIANT (5)..(5): The residue at this position is His, Gly, Ala, Glu, Gln or Ser
HHHHH

SEQ ID NO: 797 - protein, 4 aa, Artificial Sequence
  Component of peptide hormone analogue
PPPK

SEQ ID NO: 798 - protein, 5 aa, Artificial Sequence
  Component of peptide hormone analogue
SPPPK

SEQ ID NO: 799 - protein, 7 aa, Artificial Sequence
  Component of peptide hormone analogue
ESPPPGK

SEQ ID NO: 800 - protein, 6 aa, Artificial Sequence
  Component of peptide hormone analogue
ESPPPK

SEQ ID NO: 801 - protein, 4 aa, Artificial Sequence
  Component of peptide hormone analogue
SGAK

SEQ ID NO: 802 - protein, 6 aa, Artificial Sequence
  Component of peptide hormone analogue
SPPPGK

SEQ ID NO: 803 - protein, 6 aa, Artificial Sequence
  Component of peptide hormone analogue
SSSSAK

SEQ ID NO: 804 - protein, 5 aa, Artificial Sequence
  Component of peptide hormone analogue
SSSAK

SEQ ID NO: 805 - protein, 7 aa, Artificial Sequence
  Component of peptide hormone analogue
PSPPPGK

SEQ ID NO: 806 - protein, 8 aa, Artificial Sequence
  Component of peptide hormone analogue
ESPPPSGK

SEQ ID NO: 807 - protein, 4 aa, Artificial Sequence
  Component of peptide hormone analogue
  VARIANT (1)..(1): The residue at this position is Gly, Thr or absent
  VARIANT (2)..(2): The residue at this position is Ser, Gly, Thr or absent
  VARIANT (3)..(3): The residue at this position is Gly, Asn, Ser, Gln, Thr, His, Tyr, Ala or absent
  VARIANT (4)..(4): The residue at this position is Ser, Thr, His, Gln, Gly, Asn or absent
GGAN

SEQ ID NO: 808 - protein, 4 aa, Artificial Sequence
  Component of peptide hormone analogue
  VARIANT (1)..(1): The residue at this position is Gly, Thr or absent
  VARIANT (2)..(2): The residue at this position is Ser, Gly or absent
  VARIANT (3)..(3): The residue at this position is Gly, Asn, Ser, Gln, Thr, His, Tyr or absent
  VARIANT (4)..(4): The residue at this position is Ser, Thr, His, Gln, Gly, Asn or absent
GGNN

SEQ ID NO: 809 - protein, 4 aa, Artificial Sequence
  Component of peptide hormone analogue
  MOD_RES (1)..(1): The residue at this position is Gly modified with a Z group attached to its amino group
GSGS

SEQ ID NO: 810 - protein, 4 aa, Artificial Sequence
  Component of peptide hormone analogue
  MOD_RES (1)..(1): The residue at this position is Thr modified with a Z group attached to its amino group
TGSG

SEQ ID NO: 811 - protein, 29 aa, Artificial Sequence
  Component of peptide hormone analogue
  MOD_RES (2)..(2): AIB
  VARIANT (3)..(3): The residue at this position is His, Gln or Glu
  VARIANT (10)..(10): The residue at this position is Leu or Tyr
  VARIANT (12)..(12): The residue at this position is Arg or Lys
  VARIANT (13)..(13): The residue at this position is Tyr or Gln
  VARIANT (15)..(15): The residue at this position is Asp or Glu
  VARIANT (16)..(16): The residue at this position is Ala, Gln, Glu or Ser
  VARIANT (17)..(17): The residue at this position is Arg, Glu or Lys
  VARIANT (18)..(18): The residue at this position is Ala, Arg or Lys
  VARIANT (19)..(19): The residue at this position is Ala or Val
  VARIANT (20)..(20): The residue at this position is Arg, Gln or His
  VARIANT (21)..(21): The residue at this position is Asp, Glu or Leu
  VARIANT (23)..(23): The residue at this position is Ile or Val
  VARIANT (24)..(24): The residue at this position is Gln or Glu
  VARIANT (27)..(27): The residue at this position is Leu or Lys
  VARIANT (28)..(28): The residue at this position is Ala, Asn, Gln or His
  VARIANT (29)..(29): The residue at this position is Gly, Ser or Thr
HXQGTFTSDLSRQLDARAARDFIQWLLAG

SEQ ID NO: 812 - protein, 10 aa, Artificial Sequence
  Component of peptide hormone analogue
  VARIANT (1)..(1): The residue at this position is Pro, His, Glu, Ser or Ala
  VARIANT (2)..(2): The residue at this position is Ser, Gly or Thr
  VARIANT (3)..(3): The residue at this position is Pro, Glu, Gly or absent
  VARIANT (4)..(4): The residue at this position is Pro, Gly, Ser or absent
  VARIANT (5)..(5): The residue at this position is Pro, Gly, Ser or absent
  VARIANT (6)..(6): The residue at this position is Pro, Gly, Ser or absent
  VARIANT (7)..(7): The residue at this position is Gly, Ser or absent
  MOD_RES (8)..(8): The residue at this position is Lys modified with a Y2 group attached to its epsilon amino group
  VARIANT (9)..(9): The residue at this position is Ser or absent
  VARIANT (10)..(10): The residue at this position is Trp or absent
AGGGGGGKSW

SEQ ID NO: 813 - protein, 29 aa, Artificial Sequence
  Component of peptide hormone analogue
  MOD_RES (2)..(2): AIB
  VARIANT (12)..(12): The residue at this position is Arg or Lys
  VARIANT (16)..(16): The residue at this position is Ala, Gln or Glu
  VARIANT (17)..(17): The residue at this position is Arg or Lys
  VARIANT (20)..(20): The residue at this position is Gln or His
  VARIANT (28)..(28): The residue at this position is Ala, Asn, Gln or His
  VARIANT (29)..(29): The residue at this position is Gly, Ser or Thr
HXHGTFTSDYSRYLDARRAQEFIEWLLAG

SEQ ID NO: 814 - protein, 5 aa, Artificial Sequence
  Component of peptide hormone analogue
DDDDY

SEQ ID NO: 815 - protein, 5 aa, Artificial Sequence
  Component of peptide hormone analogue
HPFHL

The invention claimed is:

1. A compound of Formula (I):

X-W-Y1-Y2  Formula (I)

or a derivative or salt thereof;
wherein
X is an amino acid sequence:

(SEQ ID NO: 742)
His1-Xaa2-Xaa3-Gly4-Thr5-Phe6-Thr7-Ser8-Asp9-

Xaa10-Ser11-Xaa12-Xaa13-Leu14-Xaa15-Xaa16-Xaa17-

Xaa18-Xaa19-Xaa20-Xaa21-Phe22-Xaa23-Xaa24-Trp25-

Leu26-Xaa27-Xaa28-Xaa29- wherein
Xaa2 is AIB;
Xaa3 is His, Glu, or Gln;
Xaa10 is Leu, or Tyr;
Xaa12 is Arg, or Lys;
Xaa13 is Tyr, or Gln;
Xaa15 is Asp or Glu;
Xaa16 is Ala, Gln, Glu, or Ser;
Xaa17 is Arg, Glu, or Lys;
Xaa18 is Ala, Arg or Lys;
Xaa19 is Ala or Val;
Xaa20 is Arg, Gln or His;
Xaa21 is Asp, Leu, or Glu;
Xaa23 is Ile or Val;
Xaa24 is Gln or Glu;
Xaa27 is Leu or Lys;
Xaa28 is Ala, Asn, Gln, His, or Thr; and
Xaa29 is Gly, Ser or Thr;
W is an amino acid sequence:

(SEQ ID NO: 743)
-Xaa30-Xaa31-Xaa32-Xaa33-Xaa34-;

wherein
Xaa30 is His, Gln, or Gly;
Xaa31 is His, Gln, Glu, Gly, or Pro;
Xaa32 is His, Gln, Gly, Glu, Pro, or Ser;
Xaa33 is Ala, His, Gln, Glu, Gly, Pro, or Ser; and
Xaa34 is Ala, His, Gln, Glu, Gly, Pro or Ser;

Y1 is an amino acid sequence:

(SEQ ID NO: 744)
-Xaa35-Xaa36-Xaa37-Xaa38-Xaa39-Xaa40-Xaa41-Lys42-

Xaa43-Xaa44 wherein
Xaa35 is Pro, His, Glu, Ser or Ala;
Xaa36 is Ser, Gly, Pro or Thr;
Xaa37 is Pro, Ala, Ser, Glu, Gly or absent;
Xaa38 is Pro, Ala, Gly, Ser or absent;
Xaa39 is Pro, Gly, Ala, Ser or absent;
Xaa40 is Pro, Gly, Ser or absent;
Xaa41 is Gly, Ser or absent
Xaa43 is Ser or absent;
Xaa44 is Trp or absent;
and the lysine residue at position 42 is substituted at its ε-amino group with a group Y2 and Y2 is:

(SEQ ID NO: 745)
Z-Xaa45-Xaa46-Xaa47-Xaa48- wherein:
Xaa45 is Gly, Thr or absent;
Xaa46 is Ser, Gly, Thr or absent;
Xaa47 is Gly, Asn, Ser, Gln, Thr, His Tyr, Ala or absent;
Xaa48 is Ser, Thr, His, Gln, Gly, Asn or absent;
and Z is a group of formula:

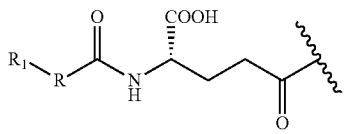 (i)

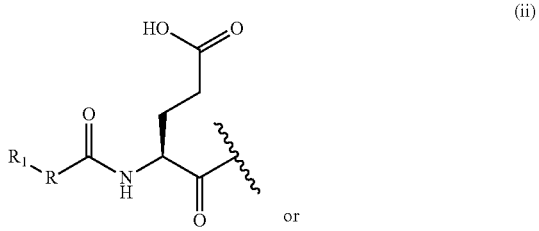 (ii)

or

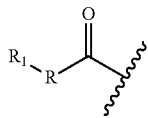

(iii)

wherein R is a $C_8$-$C_{28}$ alkylene or alkenylene group and $R^1$ is $CO_2H$.

2. The compound of claim 1, or the derivative or salt thereof, wherein:
Xaa2 is AIB;
Xaa3 is His, Gln or Glu;
Xaa10 is Leu or Tyr;
Xaa12 is Arg or Lys;
Xaa13 is Tyr or Gln;
Xaa15 is Asp or Glu;
Xaa16 is Ala, Gln, Glu or Ser;
Xaa17 is Arg, Glu or Lys;
Xaa18 is Ala, Arg or Lys;
Xaa19 is Ala or Val;
Xaa20 is Arg, Gln or His;
Xaa21 is Asp, Glu or Leu;
Xaa23 is Ile or Val;
Xaa24 is Gln or Glu;
Xaa27 is Leu or Lys;
Xaa28 is Ala, Asn, Gln or His; and
Xaa29 is Gly, Ser or Thr.

3. The compound of claim 2, or the derivative or salt thereof, wherein:
Xaa2 is AIB;
Xaa3 is His;
Xaa10 is Tyr;
Xaa12 is Lys;
Xaa13 is Tyr;
Xaa15 is Asp;
Xaa16 is Ala;
Xaa17 is Lys;
Xaa18 is Arg;
Xaa19 is Ala;
Xaa20 is Arg, Gln or His;
Xaa21 is Glu;
Xaa23 is Ile;
Xaa24 is Glu;
Xaa27 is Leu;
Xaa28 is Gln; and
Xaa29 is Ser.

4. The compound of claim 1, or the derivative or salt thereof, wherein W has an amino acid sequence selected from:

(SEQ ID NO: 752)
-Gly30-His31-His32-His33-His34-, (SEQ ID NO: 753)
-His30-His31-His32-His33-His34-, (SEQ ID NO: 754)
-His30-His31-Gln32-His33-His34-, (SEQ ID NO: 755)
-His30-Gln31-Gln32-Gln33-His34-, (SEQ ID NO: 756)
-His30-Gln31-His32-Pro33-Ser34-, (SEQ ID NO: 757)
-His30-Gln31-His32-Glu33-Ser34-, (SEQ ID NO: 758)
-His30-His31-Gln32-Glu33-Ser34-, (SEQ ID NO: 759)
-His30-His31-Gln32-Ser33-Pro34-, (SEQ ID NO: 760)
-His30-Glu31-Pro32-Ser33-Pro34-, (SEQ ID NO: 761)
-His30-Glu31-Glu32-Ser33-Pro34-, (SEQ ID NO: 762)
-His30-Gln31-Gln32-Glu33-Ser34-, (SEQ ID NO: 763)
-Gln30-His31-Gln32-His33-Gln34-, (SEQ ID NO: 764)
-His30-Gln31-Gln32-His33-His34-, (SEQ ID NO: 765)
-His30-His31-Gln32-His33-Gln34-, (SEQ ID NO: 766)
-His30-His31-Gln32-Gln33-His34-, (SEQ ID NO: 767)
-His30-Gln31-Glu32-Ser33-Pro34-, (SEQ ID NO: 768)
-His30-Gln31-Gln32-Pro33-Ser34-, (SEQ ID NO: 769)
-Gln30-Gln31-His32-Pro33-Ser34-, (SEQ ID NO: 770)
-Gln30-Gln31-His32-Glu33-Ser34-, (SEQ ID NO: 771)
-His30-Gln31-Gln32-Ser33-Pro34-, (SEQ ID NO: 772)
-His30-Gln31-Gln32-His33-Ser34-, (SEQ ID NO: 773)
-His30-Gln31-Gly32-Ala33-Pro34-, (SEQ ID NO: 774)
-Gly30-His31-Gly32-Ala33-Pro34-, (SEQ ID NO: 775)
-His30-Gly31-Gln32-Gly33-Ala34-, (SEQ ID NO: 776)
-His30-Gln31-Gln32-His33-Glu34-, (SEQ ID NO: 777)
-His30-Pro31-Ser32-Ser33-Gly34-, (SEQ ID NO: 778)
-Gln30-His31-Gln32-His33-Pro34-, (SEQ ID NO: 779)
-Gln30-Gln31-Gln32-His33-His34-, (SEQ ID NO: 780)
-His30-Gln31-His32-Gln33-His34-, (SEQ ID NO: 781)
-Gly30-Pro31-His32-Ser33-Gly34-, (SEQ ID NO: 782)
-His30-Pro31-His32-Ser33-Gly34-,

-continued

```
                                   (SEQ ID NO: 783)
-Gly30-Pro31-His32-His33-Gly34-, (SEQ ID NO: 784)
-His30-His31-Gln32-Gln33-Gln34-, (SEQ ID NO: 785)
-Gly30-Pro31-Ser32-His33-Gly34-, (SEQ ID NO: 786)
-Gly30-His31-Ser32-Ser33-Gly34-, (SEQ ID NO: 787)
-His30-Gln31-His32-Ser33-Gly34-, (SEQ ID NO: 788)
-His30-His31-Glu32-Ser33-Pro34-, (SEQ ID NO: 789)
-His30-His31-Ser32-Ser33-Gly34-, (SEQ ID NO: 790)
-His30-Gln31-Gln32-His33-Gly34-, (SEQ ID NO: 791)
-His30-His31-Gln32-His33-Glu34-, (SEQ ID NO: 792)
-His30-Gln31-Gln32-His33-Pro34-, (SEQ ID NO: 793)
-Gly30-Pro31-His32-Gln33-His34-,
and (SEQ ID NO: 794)
-Gly30-Pro31-Gln32-His33-Pro34-.
```

5. The compound of claim 1, or the derivative or salt thereof,
wherein:
Xaa30 is His or Gln;
Xaa31 is His or Gln;
Xaa32 is His or Gln;
Xaa33 is His, Gln, Glu or Pro; or
Xaa34 is His, Glu, Pro or Ser.

6. The compound of claim 5, or the derivative or salt thereof, wherein W has the amino acid sequence selected from

```
                                   (SEQ ID NO: 756)
-His30-Gln31-His32-Pro33-Ser34-, (SEQ ID NO: 776)
-His30-Gln31-Gln32-His33-Glu34-, (SEQ ID NO: 780)
-His30-Gln31-His32-Gln33-His34-, (SEQ ID NO: 766)
-His30-His31-Gln32-Gln33-His34-, (SEQ ID NO: 770)
-Gln30-Gln31-His32-Glu33-Ser34-,
and (SEQ ID NO: 792)
-His30-Gln31-Gln32-His33-Pro34-.
```

7. The compound of claim 1, or the derivative or salt thereof, wherein:
Xaa35 is Pro, Glu or Ser;
Xaa36 is Ser, Gly or Pro;
Xaa37 is Pro, Ala or Ser;
Xaa38 is Pro, Ala, Ser or absent;
Xaa39 is Pro, Gly, Ala or absent;
Xaa40 is Gly or absent;

Xaa41 is absent;
Xaa43 is absent; and
Xaa44 is absent.

8. The compound of claim 1, or the derivative or salt thereof, wherein Y1 is an amino acid sequence:

```
                                   (SEQ ID NO: 797)
-Pro35-Pro36-Pro37-Lys42;

(SEQ ID NO: 798)
-Ser35-Pro36-Pro37-Pro38-Lys42;

(SEQ ID NO: 799)
-Glu35-Ser36-Pro37-Pro38-Pro39-Gly40-Lys42;

(SEQ ID NO: 800)
-Glu35-Ser36-Pro37-Pro38-Pro39-Lys42;

(SEQ ID NO: 801)
-Ser35-Gly36-Ala37-Lys42;

(SEQ ID NO: 802)
-Ser35-Pro36-Pro37-Pro38-Gly39-Lys42;

(SEQ ID NO: 803)
-Ser35-Ser36-Ser37-Ser38-Ala39-Lys42;
or
                                   (SEQ ID NO: 804)
-Ser35-Ser36-Ser37-Ala38-Lys42.
```

9. The compound of claim 1, or the derivative or salt thereof, wherein:
Xaa45 is absent;
Xaa46 is absent;
Xaa47 is Gly, Asn or absent;
Xaa48 is Ser, His, Asn or absent;
Z is a group of formula of (i); and
R is a $C_{16}$ or $C_{18}$ straight chain alkylene group.

10. The compound of claim 9, or the derivative or salt thereof, wherein Y2 is:

```
Z-Gly47-Ser48-;

Z-Asn47-His48-;

Z-;
or
Z-Asn48-.
```

11. The compound of claim 1, or the derivative or salt thereof, wherein R is a $C_{14}$, $C_{16}$, $C_{18}$, $C_{20}$ or $C_{22}$ straight chain alkylene group.

12. The compound of claim 11, or the derivative or salt thereof, wherein Z is a group of formula:

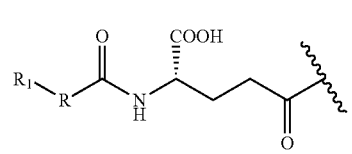

(i)

and R is a $C_{16}$ or $C_{18}$ straight chain alkylene group.

13. The compound of claim 1, or the derivative or salt thereof, wherein the compound has an amino acid sequence corresponding to any one of the amino acid sequences of SEQ ID NOs: 1-737.

14. The compound of claim 1, or the derivative or salt thereof, wherein the derivative comprises one or more derivatisations selected from amidation, glycosylation, carbamylation, acylation, sulfation, phosphorylation, cyclization, lipidization, pegylation and fusion to another peptide or protein to form a fusion protein.

15. A composition comprising the compound of claim 1, or the derivative or salt thereof, and a pharmaceutically acceptable carrier.

16. The composition of claim 15 further comprising a therapeutic agent, for simultaneous, sequential or separate administration.

17. The composition of claim 15, wherein the composition is present in a syringe or other administration device for subcutaneous administration to humans.

18. A method of reducing appetite, food intake or calorie intake in a subject comprising administration of a therapeutically effective amount of the compound of claim 1, or the derivative or salt thereof, or the composition of claim 15.

19. A method of causing weight loss or maintaining body weight in a subject for cosmetic purposes, comprising administration of an effective amount of the compound, of claim 1, or the derivative or salt thereof, or the composition of claim 15.

* * * * *